United States Patent 11,446,398 (REGULATED BIOCIRCUIT SYSTEMS) - sequence listing, part 70

SEQ ID NO: 169507 - DNA, 4481 bp, Homo sapiens
  Payload ID: 13378
  Gene Symbol: PRRG1
  Gene Name: proline rich Gla (G-carboxyglutamic acid) 1
  Uniprot ID: O14668
  ENST ID: ENST00000449135
  CDS Start-End: 157-813
gcgagtagcggagcgggacccgctgatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaaccc

SEQ ID NO: 169508 - DNA, 628 bp, Homo sapiens
  Payload ID: 13378
  Gene Symbol: PRRG1
  Gene Name: proline rich Gla (G-carboxyglutamic acid) 1
  ENST ID: ENST00000466533
  CDS Start-End: 182-628
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattgggggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctg

SEQ ID NO: 169509 - DNA, 1663 bp, Homo sapiens
  Payload ID: 13378
  Gene Symbol: PRRG1
  Gene Name: proline rich Gla (G-carboxyglutamic acid) 1
  Uniprot ID: O14668
  ENST ID: ENST00000463135
  CDS Start-End: 59-307
gcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaa

SEQ ID NO: 169510 - DNA, 582 bp, Homo sapiens
  Payload ID: 13378
  Gene Symbol: PRRG1
  Gene Name: proline rich Gla (G-carboxyglutamic acid) 1
  ENST ID: ENST00000484460
  CDS Start-End: 239-582
gcagaacggcgagtagcggagcgggacccgctgtgagtgtggcggccgcgctgggttcctagctggggaaacgtgatccaggcgaagcgccccaggaaggattggggatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagt

SEQ ID NO: 169511 - DNA, 4509 bp, Homo sapiens
  Payload ID: 13378
  Gene Symbol: PRRG1
  Gene Name: proline rich Gla (G-carboxyglutamic acid) 1
  Uniprot ID: O14668
  ENST ID: ENST00000543642
  CDS Start-End: 182-838
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattgggggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaag

SEQ ID NO: 169512 - DNA, 4600 bp, Homo sapiens
  Payload ID: 13378
  Gene Symbol: PRRG1
  Gene Name: proline rich Gla (G-carboxyglutamic acid) 1
  Uniprot ID: O14668
  ENST ID: ENST00000542554
  CDS Start-End: 273-929
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaag

SEQ ID NO: 169513 - DNA, 1404 bp, Homo sapiens
  Payload ID: 13379
  Gene Symbol: PRRG2
  Gene Name: proline rich Gla (G-carboxyglutamic acid) 2
  Uniprot ID: O14669
  ENST ID: ENST00000246794
  CDS Start-End: 170-778
acctgccagaaacggggatcaggcctggttaccgggagtggggcgcccctcctccttatcccctcccctcttccctgtcccctttcacagctggctgtagctggccaaggagttctcgattaaagaggaaggggcagtgctcacatttctgggcaggtgtctggaaaatatgaggggccacccctctctgctgctgctatatatggcattaaccacctgcctggatacttcacccagtgaggagacagaccaagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaaaggagggcgtggacgagtggatgtggccagcctggctgtggggctgacaggtggcatcctgctcattgtcctggccggcctgggagccttttggtatctgcgctggcgacagcaccgaggccagcagccctgtccccaagaggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggcctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaacccttcggaaaggagaccaaaaaaagcagaaataatgcaaaaaataataatgaaatgaactgcgatcccgggcgca

SEQ ID NO: 169514 - DNA, 435 bp, Homo sapiens
  Payload ID: 13379
  Gene Symbol: PRRG2
  Gene Name: proline rich Gla (G-carboxyglutamic acid) 2
  ENST ID: ENST00000596877
  CDS Start-End: 140-435
ttgcggaagtgcctcgcctggcttgctcaagtcctctcttctctttctctctccggaaacctggctgtagctggccaaggagttctcgattaaagaggaaggggcagtgctcacatttctgggcaggtgtctggaaaatatgaggggccacccctctctgctgctgctatatatggcattaaccacctgcctggatacttcacccagtgaggagacagaccaagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaa

SEQ ID NO: 169515 - DNA, 1538 bp, Homo sapiens
  Payload ID: 13379
  Gene Symbol: PRRG2
  Gene Name: proline rich Gla (G-carboxyglutamic acid) 2
  ENST ID: ENST00000597121
  CDS Start-End: 148-438
gcctggttaccgggagtggggcgcccctcctccttatcccctcccctcttccctgtcccctttcacagctggctgtagctggccaaggagttctcgattaaagaggaaggggcagtgctcacatttctgggcaggtgtctggaaaatatgaggggccacccctctctgctgctgctatatatggcattaaccacctgcctggatacttcacccagtgaggagacagaccaagtccttcctcttccaggagtccaggacccagccccttcctccttcagacccaggaatctggattcccagcccctgctccttcctccaggaccccactgctttccatccccctatgactccagccctagggaccctccatttttctgtccctcatgtctttgggtccagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggagcgcttttgggagagctacatctacaatggcaaaggagggcgtggacgagtggatgtggccagcctggctgtggggctgacaggtggcatcctgctcattgtcctggccggcctgggagccttttggtatctgcgctggcgacagcaccgaggccagcagccctgtccccaagaggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggcctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaacccttcggaaaggagaccaaaaaaagcagaaataatgcaaaaaataataatgaaatgaactgcga

SEQ ID NO: 169516 - DNA, 5977 bp, Homo sapiens
  Payload ID: 13380
  Gene Symbol: PRRG3
  Gene Name: proline rich Gla (G-carboxyglutamic acid) 3 (transmembrane)
  Uniprot ID: Q9BZD7
  ENST ID: ENST00000370353
  CDS Start-End: 391-1086
tagttgtgaattctggtcctgccactgtcactgttgatttgcttaaccttgtctgagcccgtctctctgggctgtatctcctcatctatctctgaggtcctttccaattggaagttgcaaagattcattgaggggagcaaggaaggaggagcctcagcctttaggagctttcctttttaaaagaaaaaggtcaacccttggttcttatagatgctcagaacatgttcttgggggaaaacgctgaaaggtttgctttgggccctactgggcctggggaggtctctggagaagagcttggggcagaatgagaagcagcggaagccatgggtggctgcatggaggacgacgcaccccacaagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaacaaaactctagcacccgggccgttcataggaggccaagggaaatttatcacatggatctgtgatgtccgcctcccctaaaacctgtccccacactcctggaaggaggacagggtgtgtgaaggatgagggccagagggctgggtggcagagtttcctcttccacattgaccaaggggcccacgtggactctgccattcagtttctagtgtgcttgtctctccagacatgtggaccagctgtgttcaaaccactacccactggcatgagcctactttttgcgaatggtgcattgaaattgaacttcagattgaggatttctccttaacgatggtgcgcatctcaggagaagatcctaaagtgtcccttttaaaacatttatttgtggagaagcccgtggcctggggttgaaggcccatatggggtttgctctgctgttgccaggtgccagtctgttttcagtgaggctttggacagcagtggggcagaaggcacctgccctttaactgtcagtgaccatgctagacactgttgataccacctccccctacttccgtctccatcctcctgacctcaacaccaaaccatttctcctctgtggtgctttaaaaattgtagcaaatttttgtgtggtgcaagaatgcatggcctgcgtctattggcaaccacagcaatttaaaatccactgagctgacaagcttttttctgtcaaaatatctctctaaggcagacattgggactcatttccttgaatgcagccctgccttcaggccacagaggacttctggaggctgctctagccctgaggacttgccctgggacgtgcttccagttagaaggcttgtgtccctaccccagtgaggccaccagcttggaccactccaccctgtggctggggttttccatccttccccctacctcacaggcccgttggaggctgactgagcaaatgcctgcgaagtgcttgaattgccggggagccagcgaggtttgccttaggaagagtcttctagaaaggtgtaggttataagggagcagtcttagctgaggccctcatatgcctctgatgttgagtctccacttggagagtcaatctcccgtcagttgaccctttccatcctctcgtcctccctttccagagctccctgatgccagagatgctggtgaatgcaggtgacattctacctttcgtttccttgtctttccctcccctgggccttcagcattgcactcctgcccttcatcacaaaggggtttttggcttaagaggcccctgctttttccatgttgggggacctggggaagcctgaagctcggggctagccctggctctcccagtatttcttcaagtaggtgccagagtgtgacctgggagcaggtgagaagaaacttatcccaatatgtctactcagttagcacagagccaggcatgagctccactgatcagagccaaagggagtttgccaagaaatgcccgctgcctttggcatctgagttgcagctgggtggtaatgggagagagcaggaagaggcccaaggcctggcccatggagggcaacatgtgtccttcaggggctgaggacaggccgtgggaagagtcacaggaggttgcttaaggcctgtgatgttcggttcagatgcttcatggtgttctgccaggtggggttgcaccacggtctctgggatggtttctgcagcacattgtagaaaaaagactgtacagcacacagcaggcatcactccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactttttaagattttttaaaagaaaaatcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcagagccggatgcttcccctctcccagtgggtggagcatcgcaacccccagccagagttgatcttttgacaacccagtgacatcccatgagaaggaagaaaaaaaattcaacactgcctctagattgttattttgtccaagagagagatcatggagagagtctctctcgctcacggaggctctgtctttctaggagtatgtgtgtgtgctgtctcatgtgtggacactcacagttgaggctgagatggatatcttggcagcagagctgctggtctaggtggcttttcagcttgacaagtaatgaagctccatttcaggacttcatcgattccgaaacaagcacagccccccaccccccgccacggaactctactaatactaatcactataattagctaatttaaaagtacggtaatcagactgcttgcaactattttaaaagcccattaatttgaagcccactacttcagaacttcgagaaaatcacaacttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtgaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaa

SEQ ID NO: 169517 - DNA, 650 bp, Homo sapiens
  Payload ID: 13380
  Gene Symbol: PRRG3
  Gene Name: proline rich Gla (G-carboxyglutamic acid) 3 (transmembrane)
  ENST ID: ENST00000370354
  CDS Start-End: 98-406
ggcgcagcagcgaggtggcgggctgcgtgcgcaaacagggcggccgccttctgggcccggagaacgagaagtgagaccctgcagctgagggagcatcatggcaggcctcagtagggctctctcctcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacggcatgtaccaccctggggctggttctgggagtaggagtagcctcaggaatagcaagaacaggccctggtaatgcagaccaatcagaagcaaggaaagacacccagcctaaggcatagccactagggccatcacggagcagataaaatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacacc

SEQ ID NO: 169518 - DNA, 379 bp, Homo sapiens
  Payload ID: 13380
  Gene Symbol: PRRG3
  Gene Name: proline rich Gla (G-carboxyglutamic acid) 3 (transmembrane)
  ENST ID: ENST00000448324
  CDS Start-End: 1-276
gacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccgcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaaca

SEQ ID NO: 169519 - DNA, 339 bp, Homo sapiens
  Payload ID: 13380
  Gene Symbol: PRRG3
  Gene Name: proline rich Gla (G-carboxyglutamic acid) 3 (transmembrane)
  ENST ID: ENST00000448726
  CDS Start-End: 184-339
gcagcgcgacgattgcggcctggcgatcggggcactgcggtcgtggcgcgcgaggcgcggggcgcgaggccagccctggaacggcggggtgtggggggcgggcagctgcggagcccccagaggaaagcaggggcaggcaggggggtgccgagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaac

SEQ ID NO: 169520 - DNA, 1303 bp, Homo sapiens
  Payload ID: 13380
  Gene Symbol: PRRG3
  Gene Name: proline rich Gla (G-carboxyglutamic acid) 3 (transmembrane)
  Uniprot ID: Q9BZD7
  ENST ID: ENST00000538575
  CDS Start-End: 50-745
aggcaggggggtgccgagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaac

SEQ ID NO: 169521 - DNA, 5530 bp, Homo sapiens
  Payload ID: 13381
  Gene Symbol: PRRG4
  Gene Name: proline rich Gla (G-carboxyglutamic acid) 4 (transmembrane)
  Uniprot ID: Q9BZD6
  ENST ID: ENST00000257836
  CDS Start-End: 254-934
cccggaccgaggcaggacctcaccccgcgcgtgttccccgggcgcccctctgcgaaccccaggcccttcccaggtttgcgcgcgggggccatccagaccctgcggagagcgaggcccggagcgtcgccgaggtttgagggcgccggagaccgagggcctggcggccgaaggaaccgccccaagaagagcctctggcccgggggctgctggaacatgtgcggggggacacagtttgtttgacagttgccagactatgtttacgcttctggttctactcagccaactgcccacagttaccctggggtttcctcattgcgcaagaggtccaaaggcttctaagcatgcgggagaagaagtgtttacatcaaaagaagaagcaaactttttcatacatagacgccttctgtataatagatttgatctggagctcttcactcccggcaacctagaaagagagtgcaatgaagaactttgcaattatgaggaagccagagagatttttgtggatgaagataaaacgattgcattttggcaggaatattcagctaaaggaccaaccacaaaatcagatggcaacagagagaaaatagatgttatgggccttctgactggattaattgctgctggagtatttttggttatttttggattacttggctactatctttgtatcactaagtgtaataggctacaacatccatgctcttcagccgtctatgaaagggggaggcacactccctccatcattttcagaagacctgaggaggctgccttgtctccattgccgccttctgtggaggatgcaggattaccttcttatgaacaggcagtggcgctgaccagaaaacacagtgtttcaccaccaccaccatatcctgggcacacaaaaggatttagggtatttaaaaaatctatgtctctcccatctcactgactaccttgtcattttggtataagaaatttgtgttatttgataggccgggcatggtggctcatgcctgtaatcccagcactttgggaggccaggagttcgagaccagcctggccaacatggtgaaacccggtctctactaaaaattcaaaaattacctaggcgtcatggggcatgcctgtagtcccacctacttgggaggctgaagcaggagaattgctcgaacctgggaggcagaggttgcagtaagctgagatcacgccactgcattccagcctgggcgacagagcaagactccatctcaaaaataaaataaaaaaagaaagaaagaaaagaagaagaaaagagaagaaggagaaggagatgaaggaggaggaggaggagaaggagaagaagaagaagaagaagaccacaaaagacatgactatccaactttttatgacaaactgcaaggaataaaggaagaataagtccatgtactgtaccacagaagttctgtctgcatcttggacctgaacttgatcattatcagcttgataagagactttttgactctatatccttgcagttaagaagaaagcacttttttgtaatgtttgttttaatggttcaaaaaaaatctttcttataaagagcataggtagaattagtgaactctttggatcctttgtacagataaaggttatagatttcttgtgttgaatattaaaaaagcaaggatgtctaaccattaagattatccaaagtcaggctgggcgcagtggctcacgcctgtaatcccagcactttgggagggataggtgggcggatcacctgaggtcaggagtttgagaccagcctggccaacatggcaaaaccccgtctctacaaaaatacaaaagaaattagccagacatgatggcgggtgcctctaatcccagctactggggaggctgaggtgggagaatcgcttgaactcgggaggtggaggttgtagtgaggcgagattgtgccattgcactccaacctgggcgacagagtgagactccatctcaaaaaaaaaaaaaaaaaaaaagattatccaaaaagatattggacctactctttcttaggatttttttggcggggggttagaaatacttcacagaatttgacatttcagtataaatctgtgaccttaatataatcacttggttttatatgttaaattattgcacagcagtcatcatattttgcagagtttagttcttaactcttgctgtcagtcatgttttattataggtagtggggtcagtagttttcttcttctaaaaaatactatttgctatgaagttagttcttcagaagatacaagtttgcaatgaaaaggatttgcaagggttgttatgctatcaaataaacagacctaaaatctaggagacactagaacttaatgaagttgcccctgttactgattagtaaatactcccatcttcgttgcaaaattatctctctgtataactacatatgattattttgaaatttgttaaacttcataagtaatagtttgagaatgtggaaaaagtaatttgcttttctgctcttaaaataatattgattaatgttaccagaaaccttttgcatctcttaatatgtctgaacacaaaaggaaaacaccataatcatataaacccattctttgtctcttcttctaaatcatatgtataaccagtttttccttaagaatgtagcagcatataagctataaatttctggagtatatgcacacaaatttatctgggtgggtatgtaggtatatgtgagtttgtttcctcttccaggagctcaagaaataacatactcctgaaaaatagaatagaaatttctgtgctttatgtttttgccaggctattacattttcttatcatttaggatcacttataaaatgatcattgtttattttgttttataatttttacaggagtgagactgcaaacccacatgtttgatagttcctaccaaattaaaagtttagaaagcataaatcatattacagtgcatatgtgagtgtatgtctctcttttaagatgcatcatcttaaggcagataaaagtaagtccttaatcattacagactgccaaagactttatccttttagattctcagtctctttgttgcttgttgcaaataaatcatctagcaacatttacatttaattaggaaatctaacttgcttttaaaagttacccacgttgcatataaaaatcttgctattccttgtgtcttggctttacataagcacttttgctcatgtgactttgcactttgcacttattttaatcctctttaaagggctacaggcaaattctactttgccataatcacactaaggcatggaagaacaacttgcccagaatctagcaggttggtgacaactgggtttagaatgagtgagcacacttttctagtcccatgtcatgcctataaaattacactgcctcgaattatgaaattcagggatcttgtacataattctaagtttgggacagaaatttacaagcatttctcatatatacatacatttatatatgtacatgttacatatatttagatgtattctcatatacatatgaaaatatttatgatgaatagaattataagatatgtatgtatcttgcactgaatcataatttgaaatatttcatgaattcatttacttctattgactcccaaaattctaactgcaagctagcttcagaacctgtgagaaccccaccccacccaagcagctgcctagatttgtctactgctatcattttgtgtaaagcagttgctctaacttgaatgagtctagaattcatcattaagattgtgatatttatagagcatccaatgtggagatcatgatactttaaatataaaaaggaaaatatgatagaactgttattgacaaatgcttataatgattgaagggaaagtatctcaacattgtatcagtcacatatatttctgttgctttcaccattttctattcctgttgtaagtttggtggtagatttagttttgtttggtttatctgttttgtttgtgttttgtctcctggcaattgattagtgttaatcattaaatctattttgacacaaggttttatatataattagatcagttttccactttattacaattaagaaatgagtaaaatatggatataaaaggagaattggattgaaaagacaaatacacatttacaaggtcatacctttggtaggacagacaattccatatagaatattctcttttgataatgaaaaaaattaaagagagcacaaactttgactatgtcaaagtatttttatttttaattttttgagacaaggtcttgctctgctacccaggctggagtgcagtggtgcaatcacaactcactgtagcctgaacttcggggctcaagcaatcctcccacctcagcctcctaagtagctgggaccacaggtgcacctcggtacacctggctaatttttgtgttttttgtagagacagggtttcaccatgttgcccatgctggtctctaactcctgagctcaaggaatccacccacctcggcctcccaaagtgctgggattacaggcatgagccaccacactggactgctgtgtcaaagttttgcatcttttttttttttttttccagaaggagtctcactttgtcacccaggctggagtgcagtggagtgatcatggctcactgcaacctccgcctcccaggttcaaggatttctcctgcctcagcctcctgagtagctgcattacaggcacctgccagcacgccttgcaaatttttgtatttttagtggagatggggttttgccatgttggccaggctggtctcaaactcctgacctcaggtgatccgcccgcctcagcctcccaaagggctgggattacaggcgtgagccactgtgcctggccccaagttttgcatcttttaatgccctctgaacaaatacatagagaaaactctcagaacaattaaaacctgcagagcaacagtgtcctccatgtcttaggtttcaagtttgcctctaaaattctaatccatatttttctacttctcagataatttatgtgtgtgtactcttcctagacgtacaagagactttttaatgctaaatatttgtcagtgcttaacaaaaactcaatttcacattactcatattgtttttgttttaattgaatgtgaattaaatttttattagttatttgatttggaatgttatgtatgccattaacactattaggggaatctctagcatttctgtatttttaaagaatttgattcttttgtagattctgcctgtgtggtcattttaaaacatgtgtgacatatatcagtaccttcattcttctatattttgtgtctcctccaacctccaactttttttgttttttgaaaaatgtttctctaacacctcaacagtttaaggtaatttagtacacatatatcagtatttttgtgatctgaaaaagcaacccattttctaaattcatatttttcctaaaactttactatgtttttattttaagaggtttcctgttatatacactttttacacatgcaaataaactttataccaagtgagta

SEQ ID NO: 169522 - DNA, 1080 bp, Homo sapiens
  Payload ID: 13382
  Gene Symbol: PRIMA1
  Gene Name: proline rich membrane anchor 1
  Uniprot ID: Q86XR5
  ENST ID: ENST00000316227
  CDS Start-End: 42-416
ctcctgacagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaccatgccatctagggagccctctgtggccatctctgcctggaccagggtggaaatgcctcttcttggtttaatgagaccagcctcagctgactcacagagctgcagagccaggctgggtcctaacaactctctctagcatttccggagccccacggggcacgcgttaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgcc

SEQ ID NO: 169523 - DNA, 3711 bp, Homo sapiens
  Payload ID: 13382
  Gene Symbol: PRIMA1
  Gene Name: proline rich membrane anchor 1
  Uniprot ID: Q86XR5
  ENST ID: ENST00000393140
  CDS Start-End: 104-565
agagctgccgcggggggaacgcggacctcttttccccgagcccagggtcggctggggccgccgccaggcaagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgccggaaaacctctcctcctcccaggaagcctgcctgctccactgttcacattctcaacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtgctcctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcatttccttctatttgaggacttgtttggggtttagatttgaattttgcttcccctggacacctgggcatcagcatagtgccaccccctgctcctgacctggccagtacttcacagtgctcttgaggtgcggagccagctgacaaataggccagagggtgtgggccagcagcaggttaaagggggaaacccagcagaccccaccccagggcactctcccctactgccttcagccttctggtgcctgttgaacccccaagctgtgccctaagcagacccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 169524 - DNA, 3649 bp, Homo sapiens
  Payload ID: 13382
  Gene Symbol: PRIMA1
  Gene Name: proline rich membrane anchor 1
  Uniprot ID: Q86XR5
  ENST ID: ENST00000393143
  CDS Start-End: 42-503
ctcctgacagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgccggaaaacctctcctcctcccaggaagcctgcctgctccactgttcacattctcaacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtgctcctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcatttccttctatttgaggacttgtttggggtttagatttgaattttgcttcccctggacacctgggcatcagcatagtgccaccccctgctcctgacctggccagtacttcacagtgctcttgaggtgcggagccagctgacaaataggccagagggtgtgggccagcagcaggttaaagggggaaacccagcagaccccaccccagggcactctcccctactgccttcagccttctggtgcctgttgaacccccaagctgtgccctaagcagacccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 169525 - DNA, 1081 bp, Homo sapiens
  Payload ID: 13382
  Gene Symbol: PRIMA1
  Gene Name: proline rich membrane anchor 1
  Uniprot ID: Q86XR5
  ENST ID: ENST00000477603
  CDS Start-End: 43-417
cgccaggcaagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaccatgccatctagggagccctctgtggccatctctgcctggaccagggtggaaatgcctcttcttggtttaatgagaccagcctcagctgactcacagagctgcagagccaggctgggtcctaacaactctctctagcatttccggagccccacggggcacgcgttaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgcc

SEQ ID NO: 169526 - DNA, 3649 bp, Homo sapiens; identical to SEQ ID NO: 169524
  Payload ID: 13382
  Gene Symbol: PRIMA1
  Gene Name: proline rich membrane anchor 1
  Uniprot ID: Q86XR5
  ENST ID: ENST00000611347
  CDS Start-End: 42-503

SEQ ID NO: 169527 - DNA, 1080 bp, Homo sapiens; identical to SEQ ID NO: 169522
  Payload ID: 13382
  Gene Symbol: PRIMA1
  Gene Name: proline rich membrane anchor 1
  Uniprot ID: Q86XR5
  ENST ID: ENST00000617019
  CDS Start-End: 42-416

SEQ ID NO: 169528 - DNA, 1081 bp, Homo sapiens; identical to SEQ ID NO: 169525
  Payload ID: 13382
  Gene Symbol: PRIMA1
  Gene Name: proline rich membrane anchor 1
  Uniprot ID: Q86XR5
  ENST ID: ENST00000627063
  CDS Start-End: 43-417

SEQ ID NO: 169529 - DNA, 3711 bp, Homo sapiens; identical to SEQ ID NO: 169523
  Payload ID: 13382
  Gene Symbol: PRIMA1
  Gene Name: proline rich membrane anchor 1
  Uniprot ID: Q86XR5
  ENST ID: ENST00000629961
  CDS Start-End: 104-565

SEQ ID NO: 169530 - DNA, 1040 bp, Homo sapiens
  Payload ID: 13383
  Gene Symbol: PROL1
  Gene Name: proline rich, lacrimal 1
  Uniprot ID: Q99935
  ENST ID: ENST00000399575
  CDS Start-End: 175-921
aactccaataaaaatccagacagaggtatttaagaagaaaggcttttctatcaaagttctttctcttcttggacttttaaattgtggctacctaaattgagtatctggcaagagtaagattaagcagtaatttgttccaaagaagaatcttctaccaaggagcaactttaaagaatgaaattaactttcttcttgggcctgttggctcttatttcatgtttcacacccagtgagagtcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaaccaccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaata

SEQ ID NO: 169531 - DNA, 944 bp, Homo sapiens
  Payload ID: 13383
  Gene Symbol: PROL1
  Gene Name: proline rich, lacrimal 1
  ENST ID: ENST00000615728
  CDS Start-End: 81-683
aattgagtatctggcaagagtaagattaagcagtaatttgttccaaagaagaatcttctaccaaggagcaactttaaagaatgaaattaactttcttcttgggcctgttggctcttatttcatgtttcacacccagtgagagtcaaagattctccagaagaccatatctacctggccagctgccaccacctccactctacaggccaagatgggttccaccaagtcccccacctccctatgactcaagacttaattcaccactttctcttccctttgtcccagggcgagttccaccatcttctttctctcgatttagccaagcagtcattctatctcaactctttccattggaatctattagacaacctcgactctttccgggttatccaaacctacatttcccactaagaccttactatgtaggacctattaggatattaaaacccccatttcctcctattcctttttttcttgctatttaccttcctatctctaaccctgagccccaaataaacatcaccaccgcagatacaacaatcaccacaaatccccccaccactgcaacagcaacccagcacttccacaaaacccacaatgacgatcagctcctcaacagtacctatctcttcaacaccagagcctgccacctccatatcagcagcaacccccgcagcatctactgaaaatactactcaaattctcgccaaccgtcctcacacagtattgctcaatgccactgtccaagttacgacttccaaccaaactatattaagcagcccagcctttaaaagtttttggcaaaaactctttgccatttttggttgaacatgcaataaatgatattttccaaactgctctgatatcttagaagaaataaactgcaatgattttgatggaaccaaccctgatctaaccagcacactaaataaagtatttgagcaata

SEQ ID NO: 169532 - DNA, 878 bp, Homo sapiens
  Payload ID: 13384
  Gene Symbol: PRORY
  Gene Name: proline rich, Y-linked
  Uniprot ID: Q9H606
  ENST ID: ENST00000382764
  CDS Start-End: 98-646
acaggaggacaaggactcaggggtctgctggtccatctctgcaccttgaaacagcagctggggcaccagaagtaacccttacagccaacaccatgtgatgatgaggaggagtccatctgggttaaagagcccacgtgtgagccaaggcaggaaaccccgggatccagaaagccttctgtttttgcgatgctgcctgggatcggagccgcacaacctgtcctcattgctctctccggaggccgggcaggaacctctgccaaagcttctacctcagccgctggcaggccatgcggcctggggcattcacggagttccaacgagtctgttactggctggggagtgctggggccagggcatggccgtgcccgctgatcctcctcctgcctctccatatcggacttctcctcgaccaccacctggaccactgccacgatatcgtccacagcagcaccttctcctccccctagggcgcctccacgctctgtgccctggctgtcctctccagcagagcctccaatttgaacggggtacactgtccgctccacgtctgtggtcatggatgaagctggaaaccatcatactaagcaaactatcacaaggacagaaaaccaaacaccgcatgttctcactgataagtgagagttgaacaatgagaacacatggacacagggcagggaacatcacccaccgaggccggtcgcgggggtggggggttgagggagggatagcatttggagaaatacctaatgtaaatgacgagttgataggggcagcaaacaaacatggaacatgtatccctatgttacaaacctgcacgttgtgtacatgtaccctagaacttacaggataataaaacaaaaaaaaaaaaaaagaaaaaa

SEQ ID NO: 169533 - DNA, 2558 bp, Homo sapiens
  Payload ID: 13385
  Gene Symbol: PROSC
  Gene Name: proline synthetase co-transcribed homolog (bacterial)
  Uniprot ID: O94903
  ENST ID: ENST00000328195
  CDS Start-End: 68-895
cggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagtaaacatggccttccaccttcagagaccatagccatcgtggagcacataaacgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttattttttatg

SEQ ID NO: 169534 - DNA, 516 bp, Homo sapiens
  Payload ID: 13385
  Gene Symbol: PROSC
  Gene Name: proline synthetase co-transcribed homolog (bacterial)
  ENST ID: ENST00000523358
  CDS Start-End: 61-516
ggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagt

SEQ ID NO: 169535 - DNA, 569 bp, Homo sapiens
  Payload ID: 13385
  Gene Symbol: PROSC
  Gene Name: proline synthetase co-transcribed homolog (bacterial)
  ENST ID: ENST00000523187
  CDS Start-End: 159-569
ggaagatggtgtgagccacgggctgccgggggcctggggctcggcgtcggtccccgggggatgtggagagctggcagcatgtcggccgagctgggagtcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagtaaacatggccttccaccttcagagaccatagccatcgtggagcacataaacgccaagtgtcctaacctggagtttgtggggctgatgaccataggaagctttgggcatgat

SEQ ID NO: 169536 - DNA, 558 bp, Homo sapiens
  Payload ID: 13385
  Gene Symbol: PROSC
  Gene Name: proline synthetase co-transcribed homolog (bacterial)
  ENST ID: ENST00000518036
  CDS Start-End: 51-275
gtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgtaagagccctttcctgaagccctttggaagcatcatgattgccaggcttctgacttgttctgttttgaccttttaggttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtcca

SEQ ID NO: 169537 - DNA, 384 bp, Homo sapiens
  Payload ID: 13385
  Gene Symbol: PROSC
  Gene Name: proline synthetase co-transcribed homolog (bacterial)
  ENST ID: ENST00000523521
  CDS Start-End: 1-384
attctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagatatacctgttttctgtttcttttcttgaaggtaaacatggccttccaccttcagagaccatagccatcgtggagcacataaacgccaagtgtcctaacctggagtttgtggggctgatgaccataggaagctttgggcatgatcttagtcaaggaccaaatccagacttccag

SEQ ID NO: 169538 - DNA, 3673 bp, Homo sapiens
  Payload ID: 13386
  Gene Symbol: PELP1
  Gene Name: proline, glutamate and leucine rich protein 1
  ENST ID: ENST00000301396
  CDS Start-End: 77-3619
acaggcagcctcatccgccatcactccgggaaccgagcaccccgctgcctcggcgcccaggctgctctctccgcgcatgctccttcccagcttgagcccgcgagtccagcctgccttcactcagtgcgcaagaccgcagccccctccccacgccccctccccagtaggcggccgtcgcggtgtgtttgcgtcatcgcgccacgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacctgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagcg

SEQ ID NO: 169539 - DNA, 3524 bp, Homo sapiens
  Payload ID: 13386
  Gene Symbol: PELP1
  Gene Name: proline, glutamate and leucine rich protein 1
  ENST ID: ENST00000436683
  CDS Start-End: 750-3470
acaggcagcctcatccgccatcactccgggaaccgagcaccccgctgcctcggcgcccaggctgctctctccgcgcatgctccttcccagcttgagcccgcgagtccagcctgccttcactcagtgcgcaagaccgcagccccctccccacgccccctccccagtaggcggccgtcgcggtgtgtttgcgtcatcgcgccacgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagtatccgtgtctccacaccctcttttctgccaggtagtggcttggatggtcagactgacattaaccgtggcattcctcagaagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagcg

SEQ ID NO: 169540 - DNA, 442 bp, Homo sapiens
  Payload ID: 13386
  Gene Symbol: PELP1
  Gene Name: proline, glutamate and leucine rich protein 1
  ENST ID: ENST00000575101
  CDS Start-End: 1-442
ggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagggcaagctggcctcattttttctgtct

SEQ ID NO: 169541 - DNA, 5272 bp, Homo sapiens
  Payload ID: 13386
  Gene Symbol: PELP1
  Gene Name: proline, glutamate and leucine rich protein 1
  ENST ID: ENST00000572293
  CDS Start-End: 65-3607
atccgccatcactccgggaaccgagcaccccgctgcctcggcgcccaggctgctctctccgcgcatgctccttcccagcttgagcccgcgagtccagcctgccttcactcagtgcgcaagaccgcagccccctccccacgccccctccccagtaggcggccgtcgcggtgtgtttgcgtcatcgcgccacgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacctgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagcgactgctgcttctgccttttgccacacctgggtccccagccagaagctcaagtgtctgctgggcttttcagggtgtccatagtattccccagatgtctccatagctgtcctctttttgacgatccagagaggaacaactgacattggtgtaatggactgtcccatcactcagcacgatggtgtcagaattgtaggattctggctggatgctaaacgtgcagaattgtgtgtagggttaagaatgaggagttatagagacacagccctgctttcgtgtttgtattcggggtgggaaatgtgtggagaatgcatcctagtgagtggacctgtgtcaacacccacatgcccacacgcatgcgtgctcagccccttggtctgaaagggcaggctgagtgattgctcagtctatggaagtttaggaaattaggaaaaggtgtggagcagtttagtcattgaattctgggaaatttggaccttaccccaagatgaaagggtgtccgtagtgggtacgttgggaatgacctctgttttggggctagtcctcctaatgacagttcccctcacagctccctggcaggagtttgataagctcaccccaggccttcctgctcactcttgaggtgtggatatttcccacccagtgtcttttcttttctttttttttttgagatggactcctgctctgtcgcccaggctggagtgcagtggcatggtctcagctcactgcaacctctgcctcccaggttcaagcaattctctgcctcagcctcctgagtagctgggattacaggcgcctgccactgcctggctaatttttgtatttttagtagaggtggggtttcaccatgttggccaggctggtcttgaactcctgagctcatggtccacctgccttggactcccaaagtgctgggatcacaagcatgagacaccgcacctgactgtcccagtgtcttttctttaagcactaatcctattctaggccttgctgggatggacgtgtgaggatgaaccgagagatgtgtctgtgagagggtaccaagattggtgggcttgaactaggggccccgtggttttttttgctcagtcagttgaatcatgaacgtaagtaaagtgccttcgcaatgcagaagagggagtcatttctcccaacatgtatcctgaagagccctttgaggaggtggcatttgagctaatttttggaaacttcagtaggattttaaaaagttacccctcaacttgttttcgaaataaacagaaaagtgagaacagtataatagataacctttgcctagatttgccaattaacatttagtcatgttaactcttatccctataaactgcgtatctacatgtagacatgtatctatattacacccatatatctgtctaatctatacatctgtagttatacacatttcttttttcatgggaccacgtgaaagtaagctgtagacaccgtggcccttcccatcccagattctttaacatgaattatcttctaagataagaatgtttttctgcacaatcctgataccattatcaaacctaagaaaaataacagtaatccagtgataattgtgatattaaaattttcctattaattcctaaa

SEQ ID NO: 169542 - DNA, 902 bp, Homo sapiens
  Payload ID: 13386
  Gene Symbol: PELP1
  Gene Name: proline, glutamate and leucine rich protein 1
  ENST ID: ENST00000570571
  CDS Start-End: 1-902
ctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatcc

SEQ ID NO: 169543 - DNA, 3280 bp, Homo sapiens
  Payload ID: 13386
  Gene Symbol: PELP1
  Gene Name: proline, glutamate and leucine rich protein 1
  ENST ID: ENST00000575329
  CDS Start-End: 1-469
aacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagtatccgtgtctccacaccctcttttctgccaggtagtggcttggatggtcagactgacattaaccgtggcattcctcagaagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactcttt

SEQ ID NO: 169544 - DNA, 567 bp, Homo sapiens
  Payload ID: 13386
  Gene Symbol: PELP1
  Gene Name: proline, glutamate and leucine rich protein 1
  ENST ID: ENST00000570387
  CDS Start-End: 269-567
ataatggatgagttcagtgtccattcagcaagcatttatggatgtctcctattaggtgctgcccagacatatagagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttagg

SEQ ID NO: 169545 - DNA, 3465 bp, Homo sapiens
  Payload ID: 13386
  Gene Symbol: PELP1
  Gene Name: proline, glutamate and leucine rich protein 1
  Uniprot ID: Q8IZL8
  ENST ID: ENST00000574876
  CDS Start-End: 19-3411
actggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacctgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagcg

SEQ ID NO: 169546 - DNA, 5747 bp, Homo sapiens
  Payload ID: 13387
  Gene Symbol: PRELP
  Gene Name: proline/arginine-rich end leucine-rich repeat protein
  Uniprot ID: P51888
  ENST ID: ENST00000343110
  CDS Start-End: 128-1276
ctgggagatcagatcttctagctggctctctgctgccacagctccgccgaagggagggggtggaagaggaggactaaactcagagctgagaggagaggcaggtgtgtgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagaaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagccatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaccctgcgtgaactcaacggtgtgaacaggtcaagaataacacttcaaagtcatcttgccagccaggcgtggtggatcacgcctgtaatcccagcactctgggaggccaaagcgggcagatcacctgaggtcaggagttcaagaccagcctggccaacatagtgaaaccccttgtttactcaaaatacaaaaattggctgggtgcggtggtacatgcctgtagtcccagctacttgggaggctgaggcaggagaattgcttgaaccctggaggcagaagttgcagtgagccgagatcgcaccactgcactccagcctaggagacaaaacgagacttcatttaaaaaaaataaaaataaaaataaaaataaagtcatcttgccacccaccccctaccattgagccaccatgcccagccccaaagcctcttaattgctctaacaagatgagtggggaaaagattatactcttaagaaattcctacgaaagctatccaaaagccttttctttcctcttttcttattatttttaaatagaggcagggtctcattatgttgcccaggctggtctggaactcctggcctcaagtgatcctcccaccttggcctccccagagtgctgggattacacacgtgagtcaccatgcccagccccaaagccatttcttgaagaatttctcgcaaactcacaaccctcatgaaaaattaatcctcagttccacgagactgcccacccacagacaaaaaaatatatatattcctaaagtcggaccagaaatctgacagctgcctttgaaacccaaagcctcgggttctttcaagctacatgtactaaattgtcgaaggtctcccaggagctctgtactgaggcagacacagaaagacacaaaacggtcgtctttcctgcccaagtaaagcttacagactaactggggagatgtagtgtgcatacaaaacagtaaaagagccatctcaaggacagagagcatagaccaagtcatctggaatggtctacatgccatgcggaagtccaccgaagggttagaacagggtgtcccagactctctcttctgagggaaggttggttgcaaaagtgggattcatgaccctcccaggctacaccatcttctttagaatgagaactgccaggtgacgccctcgctgctcctacctggctactaaacatcgacttcggttcacttcacggatgttcagtggatatcggtcacatgccaggtccccagctacgcattcaaggatggataatatacatagcagcacatccttgaggaactcataccttggtaaagggaaagaaatccatgaatggatacctctgtgtcctaagtgtttgtaataatgctgtgtgtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaa

SEQ ID NO: 169547 - DNA, 436 bp, Homo sapiens
  Payload ID: 13388
  Gene Symbol: PHGR1
  Gene Name: proline/histidine/glycine-rich 1
  Uniprot ID: C9JFL3
  ENST ID: ENST00000448599
  CDS Start-End: 57-305
agacttcctgcccctgctctgcactctcaggtattccctgctcttactccaaaaagatggacccaggtccgaaggggcactgccactgtggggggcatggccatcctccaggtcactgcgggccaccccctggccatggcccagggccctgcgggccacccccccaccatggtccagggccctgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattctttaaa

SEQ ID NO: 169548 - DNA, 1710 bp, Homo sapiens
  Payload ID: 13389
  Gene Symbol: PSRC1
  Gene Name: proline/serine-rich coiled-coil 1
  Uniprot ID: Q6PGN9
  ENST ID: ENST00000369903
  CDS Start-End: 141-1142
agaaagcctgttgcgtggaagataaggcggcgcgggaagtggacacaggctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaat

SEQ ID NO: 169549 - DNA, 1584 bp, Homo sapiens
  Payload ID: 13389
  Gene Symbol: PSRC1
  Gene Name: proline/serine-rich coiled-coil 1
  Uniprot ID: Q6PGN9
  ENST ID: ENST00000369904
  CDS Start-End: 87-1019
ctgttgcgtggaagataaggcggcgcgggaagtggacacagggtgggctggagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 169550 - DNA, 1717 bp, Homo sapiens
  Payload ID: 13389
  Gene Symbol: PSRC1
  Gene Name: proline/serine-rich coiled-coil 1
  Uniprot ID: Q6PGN9
  ENST ID: ENST00000369907
  CDS Start-End: 119-1120
ctgattcccgggactaggttgcgggagaaagcctgttgcgtggaagataaggcggcgcgggaagtggacacagggtgggctggagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 169551 - DNA, 1742 bp, Homo sapiens
  Payload ID: 13389
  Gene Symbol: PSRC1
  Gene Name: proline/serine-rich coiled-coil 1
  Uniprot ID: Q6PGN9
  ENST ID: ENST00000369909
  CDS Start-End: 145-1146
aggagccccgccccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgt

SEQ ID NO: 169552 - DNA, 1730 bp, Homo sapiens
  Payload ID: 13389
  Gene Symbol: PSRC1
  Gene Name: proline/serine-rich coiled-coil 1
  Uniprot ID: Q6PGN9
  ENST ID: ENST00000409267
  CDS Start-End: 132-1133
gggagaaagcctgttgcgtggaagataaggcggcgcgggaagtggacacagggtgggctggaggtgtgcttcgcgtgtgatgccaggggagtggaaagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 169553 - DNA, 835 bp, Homo sapiens
  Payload ID: 13389
  Gene Symbol: PSRC1
  Gene Name: proline/serine-rich coiled-coil 1
  ENST ID: ENST00000429031
  CDS Start-End: 141-835
agaaagcctgttgcgtggaagataaggcggcgcgggaagtggacacaggctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacg

SEQ ID NO: 169554 - DNA, 1040 bp, Homo sapiens
  Payload ID: 13389
  Gene Symbol: PSRC1
  Gene Name: proline/serine-rich coiled-coil 1
  ENST ID: ENST00000418914
  CDS Start-End: 425-1040
agaaagcctgttgcgtggaagataaggcggcgcgggaagtggacacagggtgggctggaggtgtgcttcgcgtgtgatgccaggggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggccca

SEQ ID NO: 169555 - DNA, 1826 bp, Homo sapiens
  Payload ID: 13389
  Gene Symbol: PSRC1
  Gene Name: proline/serine-rich coiled-coil 1
  Uniprot ID: Q6PGN9
  ENST ID: ENST00000409138
  CDS Start-End: 147-1238
gggcctgagagattcgaaaggagccccgccccctcggagctgattcccgggactaggttgcgggagaaagcctgttgcgtggaagataaggcggcgcgggaagtggacacaggatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggtgagtgggagtggggagtttgtgggattgaccctgaaatttctccacccctctccaccaggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttata

SEQ ID NO: 169556 - DNA, 366 bp, Homo sapiens
  Payload ID: 13389
  Gene Symbol: PSRC1
  Gene Name: proline/serine-rich coiled-coil 1
  ENST ID: ENST00000474126
  CDS Start-End: 1-366
gaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcggggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgc

SEQ ID NO: 169557 - DNA, 1044 bp, Homo sapiens
  Payload ID: 13390
  Gene Symbol: PRAP1
  Gene Name: proline-rich acidic protein 1
  ENST ID: ENST00000368554
  CDS Start-End: 23-955
cctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacataggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccatgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaa

SEQ ID NO: 169558 - DNA, 971 bp, Homo sapiens
  Payload ID: 13390
  Gene Symbol: PRAP1
  Gene Name: proline-rich acidic protein 1
  Uniprot ID: Q96NZ9
  ENST ID: ENST00000433452
  CDS Start-End: 273-728
tcttcctcagtcgtgtggcaggccctgagcaggcagctgggtgtccccgctcagatccaggcccgagtgggctgggcggctgcagagccagtcacctgagctacccagggtgggatccctggccccgacctctgtcctgacacgccccaagcggcagcaacaaagccccaattggcctgggcctgggcaggaggagctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccatgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggcgcggtggctcacctctgtaatcccagcacttttagaggccgaggcaggcggatcacctgaaatcaggagttccagaccagcctgggcaacatggtgaaaccccgtctctactaaaaatacaaaaattagccggg

SEQ ID NO: 169559 - DNA, 587 bp, Homo sapiens
  Payload ID: 13390
  Gene Symbol: PRAP1
  Gene Name: proline-rich acidic protein 1
  Uniprot ID: Q96NZ9
  ENST ID: ENST00000463201
  CDS Start-End: 51-479
cagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggcaccaaggcctggatggagaccgaggacaccctgggccatgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccggg

SEQ ID NO: 169560 - DNA, 5122 bp, Homo sapiens
  Payload ID: 13391
  Gene Symbol: PROB1
  Gene Name: proline-rich basic protein 1
  Uniprot ID: E7EW31
  ENST ID: ENST00000434752
  CDS Start-End: 633-3680
gccctgaggagtcagggaagcctctagcggtgctcctcactctactgaaggggatcaggaagagtgtaactggggtcaagaaaggtggtgtgtgcacccttaagagctctagctgaggccagcaatggcaatgggggtcccctgcagtgatgctaaggcacccggggctgaggggaagatgaaattgctggccctacctgagtctcctggcctgaaggtctggttcacccgctcacagcctgaactgcacacagcagtgcctgacttcaggcggatccctgctgggcttcagtttcctcacctgtgataggtggagttgggcctaactcctggctccaaggctttgaaagttgggcctgccattccctcacctgcctgtcagccaaagcttggagcccaccccaggtactccggcttgtgcctgagaagggggttagttgggcatgggggctggacagggaagggtgcagggcccaggtcttttctgctgccggcgccgctggctcaggagtggacgcggccgctttaaggcgcggtgacccccacggcatcctcgggcggggcggggacagtgccggcgccaccagcggaggcgaatgcgagggagatagtgcacggcgtccggccccaccatgctgaccgcgctcgccccgccagccctgcctgggatcccgaggcagctgcccacggcccccgcgcggcgccaggactcctccggttcgtcaggctcctactacacggctccaggttctccggagcccccggacgttgggccggacgcgaaaggcccagcgaattggccctgggtggctcctgggcggggggcgggcgcgcagcctcgcctgtccgtcagcgcccagaatagccgccagcggcacgggcccggctcgggtttcccgcgaggcccaggttccggcccacggccaccccagccccagctgcgcacgctgccgtcgggggagatggaagtcatcttcggcgtcggacccctgttcggctgctccggcgcagacgatcgcgaggcgcaacaacagttcacggagccggccttcatcagccccttgccgccggggccagcgtctcccgccgcggtcccacgccagtcccaggtccccgatggtggctcccgctgggccacctacctagagctgcggccccgtgggccaagtcctgccgccccagcgcagttcgagtgtgtggaggtggctctggaggagggcgccgcgcccgccaggccccggacagtgcccaagcgtcagatcgagctgcgcccccggccccagagtcccccaagggcggccggcgcgccgcgcccccggctgctcctgcgcaccggttccctggacgagtcgctgggccccctgcaggccgccgcgggcttcgtgcagacggcgttggccagaaaactgagccccgaggccccggccccgagcagcgccaccttcgggtccacggggcggtcggaacctgagacccgggaaacggcccgcagcacccacgtggtcctggagaaggctaagtctcggccacttcgcgtacgagataattcggcccccgccaaggccccgaggccgtggcccagcctccgcgagcgcgcgattcggcgcgacaagcctgcgcccgggacggagccgctgggtcctgttagttccagcatcttccttcagtcagaggagaagatccaggaggcgcggaagactcggttcccgcgagaggcgccggatcgaactgttcagagggcacggagtccgccttttgagtgtaggatcccctcggaggttccgagtagggctgtgaggccaaggagcccgtccccgccacggcagactccaaatggggctgtacggggtcctcgctgcccgtcgccccagaacctgtccccgtgggatcggactactcggagggtgagtagcccattgttccctgaagcctcctccgagtgggaaaatcaaaatcctgccgtcgaggaaactgtcagcaggagaagcccttcccctccgatcctttcccagtggaatcagtgtgttgctggggaaaggagcccgtccctcgaagccccttccctgtgggagattccacattcggcagtcgcggatgcggtggagccacgtagcagcccgtccccgccggccttcttcccgtgggaggctccagatcgtcctattggaacttggggcccatctccccaagagacatgggatcccatggggccgggctcatcgatagcatttactcaggaagctcagaatgggttaactcaggaggagttggcaccgcctacaccgtccgcacccggcactccagaaccaacagagatgcagagtccatccacgcgggaaatttcagatcttgcctttggagggagtcagcagtccccagaggtagcagcacccgagccgcccggcagccaccctgtgggcaccctggacgcggataagtgcccggaagtcttgggtcctggagaggcggcctcgggacgcccgcgcatggccattccgcggcctcgagacgtgcgcaagttggtgaagaccacgtacgcgccaggcttcccggcaggagcacaaggctctgggctgcctgcgcctcctgccgacccctgcggggaggagggcggcgaatccaagacgcaagagccgccagcactggggccccccgccccggctcactacacttccgttttcatcaaggattttctaccggtggtgccgcacccctacgagcctcctgaaccgtccttcgacacggtcgcccgggacgcctcacagcccaacggggtcctgcggcggagggcagagaacagcacggcgaagcccttcaagcgcacagagatccgcctgcctggggccctggccttgggtcgccggcccgaggtaacctcgcgagtgcgagcgcgcggccctggaggagagaacagggatgtagaggcccagcgcctggtccccgacggcgacggtcggaccagccctctaggcggcgcccgcagctcatcccagcgctcccccgtagggccagcaggggtccgatcgccccgccccggctcccctcagatgcaagccagcccgagccctgggatagcacccaaaccgaagacaccacctacggcccccgagcccgcggctgccgtccaggcgccactcccgcgggagcccctggcgttggcgggcaggacggccccagcccagccccgcgctgcctcggcgcctcccacggaccggtccccgcaaagcccctcccagggagcgcgcaggcagcccggggccgcgcccctggggaaggtcttggtggaccccgagagcggccgctactactttgtggaggcgccgcggcagcctcggctgcgggtgctcttcgaccctgagagtgggcagtacgtggaggtgttgctgccgccctcgtctcccgggccgccccaccgcgtctacacccctctggccctggggctcggcctctacccgcccgcctatgggcctatacccagcctctctctgccaccgtccccgggcccgcaggccctcggcagcccccagctaccctgggtctctgaggcagggcccctggacgggacctactacctgccggtgagcgggacccccaaccccgcacctcctctgctcctctgtgcgccgccctccagctcaggtcccacccagcccggcaagggttcattgttcccgctgtgaggccccgggccgatccccatggagttggagcccttggatgcctgggaggttctggcatccaagcccctaccctcctctccttccgtcgcctctgtctttaacccatcccagtcagtcgtcggacaggaagtgatcttcagagaatgaatctgagccccgaggctggtggagctggagtcacccaggaagtggctgcctacttcctcccccaacaaaattatgtatccctttcccaggcattcccagggcgtggtgtggtgtggtgtgtgggtgtgtgtatatgtgtatatgcgggcaagcaaatagggaaagtgaggcatccctgggcttgtccccaggagccgatcagaggaggtgctgtggctgccgtggggcagcaggaacgggagcagcaggagacagggcggggaactgtctgccctccctgatggtgggcccagctgaggtgaggctggccagtgcccctggtgaggtggcaggaaggactctggctgtcgagtctgctcttaggaagaggagctgagctttggccctggaggttactggggggaaagtggccagtacagcccaggccaggctggctccgagaaagagctaaggcgggggacagcaggtggaggcaaagcaaggaatacagggagggcctgggttgggggttagcctggaacttggggtgggaagatggggagcctggccctcagagctgagctgactcatttttgggccaggggtggggcttcagtcccccaccccctacatcgggagtaggtgaaatggtcatcaggaagctctgagaagagggagggttgggctcttgtcccacaggagcctcttgacccctctgtgtggccagaaggtgggttagggccagcagtagaagcgatacccctggtggagtatccagagggatctgaagctcttggcaggttccactccccagtaacagatgtggcaacaatggccagagaggggctggccctacagaccagtcacagcaagggacagggcccagagcctgcacttcagttgccctgagattccaggagcctctgagggagatgaggggggtctgcatgaggtgggaggtggtgtgcgtgggggtctgtatatagttctgaaccggaaatggctggcccttgccagcctggtgtgtgatgtgatgagtttgggaaggacagtttccatgagaagcagtggcagggatggggatggatgccttcgttgttccaggcctgtcagggggcccaggtccctagcagtccctgccctctgccctggactggaagctgactaggagagctacgaatcagaacaactggccattttctagctggagatgccagctccgatggcatggagggccctggggccaccccaggtgtctttacctcatcctggtgtgtaataaatcactgaccatggagccatcatggctgaaataa

SEQ ID NO: 169561 - DNA, 4699 bp, Homo sapiens
  Payload ID: 13392
  Gene Symbol: PRRC1
  Gene Name: proline-rich coiled-coil 1
  Uniprot ID: Q96M27
  ENST ID: ENST00000296666
  CDS Start-End: 189-1526
gcagccgcaggagcatgcgccgcccgtggccatcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagacattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaaattatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaagaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttctttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaa

SEQ ID NO: 169562 - DNA, 5504 bp, Homo sapiens
  Payload ID: 13392
  Gene Symbol: PRRC1
  Gene Name: proline-rich coiled-coil 1
  Uniprot ID: Q96M27
  ENST ID: ENST00000442138
  CDS Start-End: 147-1403
ggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggttggttttctcctttgctttttcattatgctccagagaaacttacactattgttttcagaataaaaatttgttcggtttttttgttagaaatatgttcttgattttgtttcagtcatttttcttttagtatttttctttgctttttaatttcctgatccttccatgttgttttagtaccttcctccttttgttttccaggtgtctttgaaaggtaatacattacatggttaatcattatttctctcatttttttctttgtttttactctgagttctggaaaagatttaccttttctagttgttttatgtccgcctttcgtttgctttcccttttatctcacatttcatttccactgttatctccatttcccttttccttgattgattgtcctcctgttcatctttagtgaaatcaacattagaaaccttataggcacgtgtctttaggtttttggctgaaaaatggacctaatagtgtacctatccacacagtttccaggagaatgtaagtataaatgataatccttattcctctttttttttttttttggtgtgttttctctaatcctttcatgaacaaaatggaatataaatatatacttgcattggaatctctgtgctcttaagtggtattctattgacttttttctgtcaatttcataaaatttttgttacagttgtagtttgtacattgttaaatatcatttcaaaactgcctttcaaacttatttgggacatgaagacatttgagaatctaagaaaactattgggctgtctcccaagaaaaatgcgtgtatgtgtactttcatagaactttggcatatgtgttcacataatccctaaaagtaacctctggcctacttattacagtttagaaagggggctaagaattgatgcttggaatttgaaattttactgaaacttttatttataccgtaatttcttttcataagttcaagaaaacctttttatagatattaacattacactcatttcaatatgaaggtgattaaaagactgtaagtgaatactatgcatactgttatgccaataaattagaaaaattaggtgaaagagtggattttctaggaaaatagaagttttgccatagttaagagtattaggttgaaccaaatgacgttgttgcctttgatggtcagaaatagttatatattgtcagtttcatatgattcagcttaattgaagcattaaaatggaagaactttatgtaactaaaaaaaaaaaaatcactgagtaccaatggtgttacaagtgagttctacaaaatgttcagagatgatttgctgtatgaggtatcaaaaatagaggtagagagttttccagttcattctgtgagactagcctcttttaactttaaatgaaattatagtccaaagaactaaatgtcaaaaccattggtaaaattaataaataaaattcagaaatgtattagatgaacattgtatcctgaccatgaaaaatttgtcccaagaacagcagaatggttcaacaatagtaaatttatgtaattcagtacatgaacatctgcattgaaaggagaaaaaagattttgataagagttgaaggtatttgctagaaataatcatactaatagctcttagtattagacgggtatgtgtgtactacaaaatcaaagcaaacttcagatctaataaataaaacactgaaaacgttataattatgaggatgctcctgtcactgccactgttaacattgctgtagatctggggtcagcaaacagtggctcacagccaaatctggcctgtcatctttttgtaattaagtttattggaacacacccatgccagtttgcttacttattgtttatagctgcttttgtactatagcagcagaaatgaatagttgcaacagagaatgtctggcccacaaagcctaaaatatttaccatctggctcttttcagaaaaagtttgctgacccctgtgttagatatctgaccattgcaaaggacaatttttatgttgtttttaggaatatatactggaaagaagtagacatgaaagaatgaagtggactcgtgtgtaccagtaccaaaagatagctattacatattgctgagtaaaagtcaaaaacagcacatctagtatgatcccatttactagcaggcgtgtgtatgtgtgtgctttaaaattttaataagaatagggaaaaaggcctggaaagataacacagcaaactgttaatagtggttaattctgaataatggtatttaaagggtgttatttgctttttactttgctttttattctgtttgttttattttgtgtcatttggttttaaaatttagaagatacaaaactgtgtgcattgaaatgtcttctttttatcctcagctattcagctctcctccctgtttctttttattcattctaaaatgttttatgcttttttattgttggaattttttaatttaaggtaatggaaatcagcccttcaggtaattagaattatcagtatatattagtaaaaatctggaaataaatttcatacaatttgtacttgttaaacttaaatataaatgattcctcacccccataaaaaaccccagctgttctggatttttgccaataatatagaataccttgtttctaaaaagtgtggtccttggcttaacatcataagcagcacctagaaatttgttaaaatgcagattctcgggtcctaacacaggactagtgaatcaggagctgcattttaacaagatattcaggggattcataggcatgccataatttgagaagcacagtgttactggtgtctctgaggacgttagtagtatatctgctgtttctctttgaaatatagtgaaatactgatactgtagtatacacattggaagagagtacttagagcaggggttcccaagtgctggactgtttgcatcagattgacttggaagctattttacgtacgtaatactgtactgtttctcttggaaccagctgtagagtttccaattcagttatcttggtgtctcagttatcttagtgggatgtgagaaactggatatcgttaaaaaagaaaaaagaaacaagagctcctcaggtgattgtaatacatggcacatttggtagtcatgtataactgtatagatccgttctagatgtggctatacttctctggactatacctaacaccctaaaacagaaaaaccacatcagtcttggatatcaagcaatgagtttattcttctgtcattcctttgtagatgaataaatgatttgaataggagcaaatatgagttgggtcaattaggaatgttgcatcagtggttgatgttgtccaggactggatattacttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaa

SEQ ID NO: 169563 - DNA, 2726 bp, Homo sapiens
  Payload ID: 13392
  Gene Symbol: PRRC1
  Gene Name: proline-rich coiled-coil 1
  Uniprot ID: Q96M27
  ENST ID: ENST00000512635
  CDS Start-End: 142-1530
cacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcggatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgactta

SEQ ID NO: 169564 - DNA, 6861 bp, Homo sapiens
  Payload ID: 13393
  Gene Symbol: PRRC2A
  Gene Name: proline-rich coiled-coil 2A
  Uniprot ID: P48634
  ENST ID: ENST00000376007
  CDS Start-End: 203-6676
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggtgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 169565 - DNA, 6893 bp, Homo sapiens
  Payload ID: 13393
  Gene Symbol: PRRC2A
  Gene Name: proline-rich coiled-coil 2A
  Uniprot ID: P48634
  ENST ID: ENST00000376033
  CDS Start-End: 235-6708
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggtgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 169566 - DNA, 6893 bp, Homo sapiens
  Payload ID: 13393
  Gene Symbol: PRRC2A
  Gene Name: proline-rich coiled-coil 2A
  Uniprot ID: P48634
  ENST ID: ENST00000383455
  CDS Start-End: 235-6708
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 169567 - DNA, 6861 bp, Homo sapiens
  Payload ID: 13393
  Gene Symbol: PRRC2A
  Gene Name: proline-rich coiled-coil 2A
  Uniprot ID: P48634
  ENST ID: ENST00000383464
  CDS Start-End: 203-6676
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaa

SEQ ID NO: 169568 - DNA, 6861 bp, Homo sapiens
  Payload ID: 13393
  Gene Symbol: PRRC2A
  Gene Name: proline-rich coiled-coil 2A
  Uniprot ID: P48634
  ENST ID: ENST00000454306
  CDS Start-End: 203-6676
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggatttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169569 - DNA, 6893 bp, Homo sapiens
  Payload ID: 13393
  Gene Symbol: PRRC2A
  Gene Name: proline-rich coiled-coil 2A
  Uniprot ID: P48634
  ENST ID: ENST00000428775
  CDS Start-End: 235-6708
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169570 - DNA, 6861 bp, Homo sapiens
  Payload ID: 13393
  Gene Symbol: PRRC2A
  Gene Name: proline-rich coiled-coil 2A
  Uniprot ID: P48634
  ENST ID: ENST00000458561
  CDS Start-End: 203-6676
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169571 - DNA, 6861 bp, Homo sapiens
  Payload ID: 13393
  Gene Symbol: PRRC2A
  Gene Name: proline-rich coiled-coil 2A
  Uniprot ID: P48634
  ENST ID: ENST00000439762
  CDS Start-End: 203-6676
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgctggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169572 - DNA, 6893 bp, Homo sapiens
  Payload ID: 13393
  Gene Symbol: PRRC2A
  Gene Name: proline-rich coiled-coil 2A
  Uniprot ID: P48634
  ENST ID: ENST00000414956
  CDS Start-End: 235-6708
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169573 - DNA, 6893 bp, Homo sapiens
  Payload ID: 13393
  Gene Symbol: PRRC2A
  Gene Name: proline-rich coiled-coil 2A
  Uniprot ID: P48634
  ENST ID: ENST00000432252
  CDS Start-End: 235-6708
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggatttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169574 - DNA, 6861 bp, Homo sapiens
  Payload ID: 13393
  Gene Symbol: PRRC2A
  Gene Name: proline-rich coiled-coil 2A
  Uniprot ID: P48634
  ENST ID: ENST00000435971
  CDS Start-End: 203-6676
gggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtgggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcatacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcagttacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccaccttccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169575 - DNA, 6861 bp, Homo sapiens; identical to SEQ ID NO: 169567
  Payload ID: 13393
  Gene Symbol: PRRC2A
  Gene Name: proline-rich coiled-coil 2A
  Uniprot ID: P48634
  ENST ID: ENST00000430737
  CDS Start-End: 203-6676

SEQ ID NO: 169576 - DNA, 6893 bp, Homo sapiens
  Payload ID: 13393
  Gene Symbol: PRRC2A
  Gene Name: proline-rich coiled-coil 2A
  Uniprot ID: P48634
  ENST ID: ENST00000416335
  CDS Start-End: 235-6708
cagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgctggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaa

SEQ ID NO: 169577 - DNA, 6893 bp, Homo sapiens; identical to SEQ ID NO: 169566
  Payload ID: 13393
  Gene Symbol: PRRC2A
  Gene Name: proline-rich coiled-coil 2A
  Uniprot ID: P48634
  ENST ID: ENST00000422962
  CDS Start-End: 235-6708

SEQ ID NO: 169578 - DNA, 4950 bp, Homo sapiens
  Payload ID: 13394
  Gene Symbol: PRRC2B
  Gene Name: proline-rich coiled-coil 2B
  ENST ID: ENST00000320547
  CDS Start-End: 1-535
cagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaa

SEQ ID NO: 169579 - DNA, 11042 bp, Homo sapiens
  Payload ID: 13394
  Gene Symbol: PRRC2B
  Gene Name: proline-rich coiled-coil 2B
  Uniprot ID: Q5JSZ5
  ENST ID: ENST00000357304
  CDS Start-End: 56-6745
gcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacgggagccccaacaaacagccatcctcggagcctgaatggactcccgagccccggagctccagcagccagcacccggagcagacgggcaggacccggaggtcgggacccatcaagaaaccagtcctgaaagccctcaaggtggaagacaaggagaaggagcttgagaagattaagcaggagctaggggaggagagtacccggctggccaaggagaaggagcagagccccacggcagaaaaggatgaggacgaagagaacgatgcctctctggccaactcctccaccaccactttggaggacaaaggccctggccatgccacttttggccgcgaggccaccaaatttgaagaggaggagaaacctgacaaggcctgggaagccagacccccacgagagtccagcgatgttccccccatgaagagaaataactggatctttattgatgaggagcaagcctttggggtcagaggacaggcccggggccggggccgtggtttcagagagttcacttttcgtggtcggcctgctggcggaaatgggagcggcctctgtggtgggggggtcctgggggcccgcagcatctactgcagcagtcagcgcagcggccgtggccggggcctgcgagagtttgcgcggccagaggactgccccagagccaagccccgacggagagttgccagtgagacccatagcgagggctcagagtatgaagaacttcccaagcgccgccggcagaggggctccgagaacgggaatgaaggctcgctcctggagagggaggagagcaccttgaagaagggcgactgcagagattcttggcggtccaacaaggggtgctctgaggaccacagcggtctagatgccaagagccgaggccctcgggcctttgggcgagccctccctccccggctgagcaattgcgggtatggacggagaaccttcgtctccaaagagtcaccccactggcagagcaaaagtccaggcagctcttggcaggaatatggcccttccgacacatgcggatcccggcgacctacagacagagactatgtcccagattcctacagacaccctgacgcatttggtggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttattt

SEQ ID NO: 169580 - DNA, 9157 bp, Homo sapiens
  Payload ID: 13394
  Gene Symbol: PRRC2B
  Gene Name: proline-rich coiled-coil 2B
  Uniprot ID: Q5JSZ5
  ENST ID: ENST00000405995
  CDS Start-End: 227-4834
gcgccgaggctccaccgcgcagcgacgagcgagcccgggaggagggagggagcgagcgagcgagcagcccgcgccgccgcctcgcaatccgccgccatcccgccgcccccgtgcccgaccgccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaa

SEQ ID NO: 169581 - DNA, 1762 bp, Homo sapiens
  Payload ID: 13394
  Gene Symbol: PRRC2B
  Gene Name: proline-rich coiled-coil 2B
  ENST ID: ENST00000451855
  CDS Start-End: 1-1762
tggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaag

SEQ ID NO: 169582 - DNA, 535 bp, Homo sapiens
  Payload ID: 13394
  Gene Symbol: PRRC2B
  Gene Name: proline-rich coiled-coil 2B
  ENST ID: ENST00000422467
  CDS Start-End: 1-535
tgtgaaggacggcaggccaaagtgaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagc

SEQ ID NO: 169583 - DNA, 899 bp, Homo sapiens
  Payload ID: 13394
  Gene Symbol: PRRC2B
  Gene Name: proline-rich coiled-coil 2B
  Uniprot ID: Q5JSZ5
  ENST ID: ENST00000458550
  CDS Start-End: 1-807
atgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctga

SEQ ID NO: 169584 - DNA, 525 bp, Homo sapiens
  Payload ID: 13394
  Gene Symbol: PRRC2B
  Gene Name: proline-rich coiled-coil 2B
  ENST ID: ENST00000456307
  CDS Start-End: 1-525
gaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacggg

SEQ ID NO: 169585 - DNA, 10355 bp, Homo sapiens
  Payload ID: 13395
  Gene Symbol: PRRC2C
  Gene Name: proline-rich coiled-coil 2C
  Uniprot ID: Q9Y520
  ENST ID: ENST00000338920
  CDS Start-End: 238-8691
ctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatga

SEQ ID NO: 169586 - DNA, 10366 bp, Homo sapiens
  Payload ID: 13395
  Gene Symbol: PRRC2C
  Gene Name: proline-rich coiled-coil 2C
  ENST ID: ENST00000367742
  CDS Start-End: 243-8702
gctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatga

SEQ ID NO: 169587 - DNA, 1919 bp, Homo sapiens
  Payload ID: 13395
  Gene Symbol: PRRC2C
  Gene Name: proline-rich coiled-coil 2C
  ENST ID: ENST00000392078
  CDS Start-End: 968-1864
gctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagttgcagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggaatccaagtgaatagtcagtttcagcaagaatttcccagcctgcaggcagctggggatcaggaaaaaaaagaaaaggaaacaaatgatgacaactatggacctggacccagtttacgtccaccaaactagatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagc

SEQ ID NO: 169588 - DNA, 10175 bp, Homo sapiens
  Payload ID: 13395
  Gene Symbol: PRRC2C
  Gene Name: proline-rich coiled-coil 2C
  Uniprot ID: Q9Y520
  ENST ID: ENST00000426496
  CDS Start-End: 58-8511
gactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatga

SEQ ID NO: 169589 - DNA, 5566 bp, Homo sapiens
  Payload ID: 13395
  Gene Symbol: PRRC2C
  Gene Name: proline-rich coiled-coil 2C
  ENST ID: ENST00000495585
  CDS Start-End: 1-3902
tagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatga

SEQ ID NO: 169590 - DNA, 2065 bp, Homo sapiens
  Payload ID: 13396
  Gene Symbol: PNRC1
  Gene Name: proline-rich nuclear receptor coactivator 1
  Uniprot ID: Q12796
  ENST ID: ENST00000336032
  CDS Start-End: 118-1101
tgttccgcgatcttctcaggctctcctagcagcatccatcgccgccaccctatcttcactggcttcattcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacaga

SEQ ID NO: 169591 - DNA, 1345 bp, Homo sapiens
  Payload ID: 13396
  Gene Symbol: PNRC1
  Gene Name: proline-rich nuclear receptor coactivator 1
  ENST ID: ENST00000354922
  CDS Start-End: 916-1344
ggcgaggccgggtgggggcagctggggaaggactgggcccggctttcggcctcccggctatcgggagccccagtcctagtcggtgaaacgcggagacggcctctaacgtcccgccgtagggggtggagtgggctccgagcggctgggtttcgtttggttggagttgtgccaaaatgtgaggtgcccggtgtgggacgcgcagtccagttggggctctgcccgcctcgggcctgacctacttagtggttccaagttaagagttggcaggagccgcacaaaactgattttattacttttgccactgtggtacttcgtgttagtgtgtccagagtaagttttcagaagagttagcaattgaattgacttagcccgtctgattgcagtgctattgcattaggataaaatggatagaagtttaaataggattaagtctacgaaatgatttcaaagtcttgtcagaataacgttttatggacttaagttcaatgacttaatcttcgtaataatgaaatgaaaaagttcccgttatttagtgaagaatgttgcattgaattagagatttgcggtttatctgtgcccttgggaaaaaatttgcccaccttgtttctttaaattatcgtctcaatgtctcccttttaaaattccacgacttttgaaatatccgtgattacctaaaagcttttgtgcttgtttcctggcctgttttctagaacaggtactaactagggagctctggcagtgaaccttattgacgtggaaagttgtggtcctctttcgtgtcgtgtcttgcttactaccgcgttacaagtgttggtagtgcagtgatctagtggattaccttacgcttttccatcctttcaagacttcctataaggcccacttaagttgggaaagattaaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttaga

SEQ ID NO: 169592 - DNA, 816 bp, Homo sapiens
  Payload ID: 13396
  Gene Symbol: PNRC1
  Gene Name: proline-rich nuclear receptor coactivator 1
  ENST ID: ENST00000369472
  CDS Start-End: 239-667
gttgctgcgccgccaccgcccgagtcatgttccgcgatcttctcaggctctcctagcagcatccatcgccgccaccctatcttcactggcttcattcaccttctccttctctcttcgttgctgagcgacaagcttcctagcgctatgactgtcgtctccgtcccgcagcgggagccgctcgtcctgggtggccgccttgcgccgcttggcttttcctcccgaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtatta

SEQ ID NO: 169593 - DNA, 2416 bp, Homo sapiens
  Payload ID: 13397
  Gene Symbol: PNRC2
  Gene Name: proline-rich nuclear receptor coactivator 2
  Uniprot ID: Q9NPJ4
  ENST ID: ENST00000334351
  CDS Start-End: 412-831
ctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaatgtgaagcataaaattaaataaaatttttccccattggcttggttttattttaaaaa

SEQ ID NO: 169594 - DNA, 814 bp, Homo sapiens
  Payload ID: 13397
  Gene Symbol: PNRC2
  Gene Name: proline-rich nuclear receptor coactivator 2
  Uniprot ID: Q9NPJ4
  ENST ID: ENST00000374468
  CDS Start-End: 392-811
gtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcagacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaat

SEQ ID NO: 169595 - DNA, 171 bp, Homo sapiens
  Payload ID: 13397
  Gene Symbol: PNRC2
  Gene Name: proline-rich nuclear receptor coactivator 2
  ENST ID: ENST00000579103
  CDS Start-End: 1-171
atgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtga

SEQ ID NO: 169596 - DNA, 380 bp, Homo sapiens
  Payload ID: 13397
  Gene Symbol: PNRC2
  Gene Name: proline-rich nuclear receptor coactivator 2
  ENST ID: ENST00000471915
  CDS Start-End: 373-380
tgggtggggagagctgcagccacaggaaacggtaacacggcgcgtaaagggctctaattgaacttaaggaccaatggggccaccaagcaggaagtgactgacttgcccgcgtgtgtctgaaccgccttcacagggaggcaacttttgactaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtgg

SEQ ID NO: 169597 - DNA, 775 bp, Homo sapiens
  Payload ID: 13398
  Gene Symbol: PRB1
  Gene Name: proline-rich protein BstNI subfamily 1
  ENST ID: ENST00000500254
  CDS Start-End: 39-635
agcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccagggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggaaagccacaaggaccacccccacaaggaggcaacaaacctcaaggtcccccacctccaggaaagccacaaggaccacccgcacaaggaggcagcaagtcccaaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169598 - DNA, 1170 bp, Homo sapiens
  Payload ID: 13398
  Gene Symbol: PRB1
  Gene Name: proline-rich protein BstNI subfamily 1
  ENST ID: ENST00000546254
  CDS Start-End: 38-1030
gcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccagggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggtaaccagccccaaggtcccccacctcctccaggaaagccacaaggaccacccccacaaggaggcaacagacctcaaggtcccccacctccaggaaagccacaaggaccacccccacaaggagacaagtcccgaagtccctctcctccaggaaagccacaaggaccacccccacaaggaggtaaccaaccccaaggtcccccacctcctccaggaaagccacaaggaccacccccacaaggaggcaagaaacctcagggtcccccacctccaggaaagccacaaggaccacccccacaaggagacaagtcccgaagttcccaatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccgcacaaggaggcagcaagtcccaaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169599 - DNA, 710 bp, Homo sapiens
  Payload ID: 13398
  Gene Symbol: PRB1
  Gene Name: proline-rich protein BstNI subfamily 1
  ENST ID: ENST00000545626
  CDS Start-End: 34-570
agagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccagggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggaaagccacaaggaccacccgcacaaggaggcagcaagtcccaaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169600 - DNA, 1428 bp, Homo sapiens
  Payload ID: 13398
  Gene Symbol: PRB1
  Gene Name: proline-rich protein BstNI subfamily 1
  ENST ID: ENST00000612920
  CDS Start-End: 36-1286
acagagttgggagtgactccagagcctcctgcaagatgctgttgattctgctgtcagtggccctgctggccctgagctcagctcagaacttaaatgaagatgtcagccaggaagaatctccctccctaatagcaggaaatccacaaggagcacccccacaaggaggcaacaaacctcaaggtcccccatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccgaagtgcccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggaggcagcaagtcccgaagttctcgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgcaa

SEQ ID NO: 169601 - DNA, 1170 bp, Homo sapiens; identical to SEQ ID NO: 169598
  Payload ID: 13398
  Gene Symbol: PRB1
  Gene Name: proline-rich protein BstNI subfamily 1
  ENST ID: ENST00000622081
  CDS Start-End: 38-1030

SEQ ID NO: 169602 - DNA, 1179 bp, Homo sapiens
  Payload ID: 13398
  Gene Symbol: PRB1
  Gene Name: proline-rich protein BstNI subfamily 1
  ENST ID: ENST00000615646
  CDS Start-End: 38-1039
gcacagagttgggagtgactccagagcctcctgcaagatgctgttgattctgctgtcagtggccctgctggccctgagctcagctcagaacttaaatgaagatgtcagccaggaagaatctccctccctaatagcaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccgaagtgcccgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccgaagtgcccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169603 - DNA, 710 bp, Homo sapiens
  Payload ID: 13398
  Gene Symbol: PRB1
  Gene Name: proline-rich protein BstNI subfamily 1
  ENST ID: ENST00000620127
  CDS Start-End: 34-570
agagttgggagtgactccagagcctcctgcaagatgctgttgattctgctgtcagtggccctgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169604 - DNA, 1173 bp, Homo sapiens
  Payload ID: 13398
  Gene Symbol: PRB1
  Gene Name: proline-rich protein BstNI subfamily 1
  ENST ID: ENST00000240636
  CDS Start-End: 38-493
gcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccagggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggtaaccagccccaaggtcccccacctcctccaggaaagccacaaggaccacccccacaaggaggcaacagacctcaaggtcccccacctccaggaaagccacaaggaccacccccacaaggagacaagtcccgaagtccctgatctcctccaggaaagccacaaggaccacccccacaaggaggtaaccaaccccaaggtcccccacctcctccaggaaagccacaaggaccacccccacaaggaggcaagaaacctcagggtcccccacctccaggaaagccacaaggaccacccccacaaggagacaagtcccgaagttcccaatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccgcacaaggaggcagcaagtcccaaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169605 - DNA, 1920 bp, Homo sapiens
  Payload ID: 13398
  Gene Symbol: PRB1
  Gene Name: proline-rich protein BstNI subfamily 1
  ENST ID: ENST00000625471
  CDS Start-End: 38-1780
gcacagagttgggagtgactccagagcctcctgcaagatgctgttgattctgctgtcagtggccctgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccgaagtgcccgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccgaagtgcccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggaggcagcaagtcccgaagttctcgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169606 - DNA, 762 bp, Homo sapiens
  Payload ID: 13398
  Gene Symbol: PRB1
  Gene Name: proline-rich protein BstNI subfamily 1
  ENST ID: ENST00000628976
  CDS Start-End: 26-622
gagtgactccagagcctcctgcaagatgctgttgattctgctgtcagtggccctgctggccctgagctcagctcagaacttaaatgaagatgtcagccaggaagaatctccctccctaatagcaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 169607 - DNA, 710 bp, Homo sapiens; identical to SEQ ID NO: 169599
  Payload ID: 13398
  Gene Symbol: PRB1
  Gene Name: proline-rich protein BstNI subfamily 1
  ENST ID: ENST00000632933
  CDS Start-End: 34-570

SEQ ID NO: 169608 - DNA, 775 bp, Homo sapiens; identical to SEQ ID NO: 169597
  Payload ID: 13398
  Gene Symbol: PRB1
  Gene Name: proline-rich protein BstNI subfamily 1
  ENST ID: ENST00000633958
  CDS Start-End: 39-635

SEQ ID NO: 169609 - DNA, 1429 bp, Homo sapiens
  Payload ID: 13399
  Gene Symbol: PRB2
  Gene Name: proline-rich protein BstNI subfamily 2
  Uniprot ID: P02812
  ENST ID: ENST00000389362
  CDS Start-End: 37-1287
cacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggagcacccccacaaggaggcaacaaacctcaaggtcccccatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccaaagtgcccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggaggcagcaagtcccgaagttctcgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattggaaaaaggtcatcatagctctaacttctgtataccaataaaataattagcttgcaa

SEQ ID NO: 169610 - DNA, 100 bp, Homo sapiens
  Payload ID: 13399
  Gene Symbol: PRB2
  Gene Name: proline-rich protein BstNI subfamily 2
  ENST ID: ENST00000565533
  CDS Start-End: 37-100
cacagagttgggagtgactccagagcctcctgcaagatgctgttgattctgctgtcagtggccttgctggccctgagctcagctcagaacttaaatgaag

SEQ ID NO: 169611 - DNA, 1091 bp, Homo sapiens
  Payload ID: 13400
  Gene Symbol: PRB3
  Gene Name: proline-rich protein BstNI subfamily 3
  Uniprot ID: Q04118
  ENST ID: ENST00000381842
  CDS Start-End: 39-968
agcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccgcctcgtccgggaaagccagaaggaccacccccacaaggaggaaaccagtcccaaggtcccccgcctcatccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggaccaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaacaagaagatgacagtgattcaaatgattcaaatgccatgacattggaagaaggtggtcatagctctacctttaatataccaataaaataaacagctta

SEQ ID NO: 169612 - DNA, 1283 bp, Homo sapiens
  Payload ID: 13400
  Gene Symbol: PRB3
  Gene Name: proline-rich protein BstNI subfamily 3
  ENST ID: ENST00000538488
  CDS Start-End: 137-1192
agaacccagtctctggggtggtgaggcccacccagtgtggagctcaaaggtgccactgttctgctcctctttataaagggagctgccatggttctcccagcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccgcctcgtccgggaaagccagaaggaccacccccacaaggaggaaaccagtcccaaggtcccccgcctcatccgggaaagccagaaggaccacccccacaaggaggaaaccagtcccaaggtcccccacctcgtccgggaaagccagaaggaccacccccacaaggaggaaaccagtcccaaggtcccccacctcgtccgggaaagccagaaggaccacccccacaaggaggcaacaaacctcaaggtcccccacctcgtccaggaaagccagaaggaccacccccacaaggaggaaaccagtcccaaggtcccccacctcgtccaggaaagccagaaggaccaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaacaagaagatgacagtgattcaaatgattcaaatgccatgacattggaagaaggtggtcatagctct

SEQ ID NO: 169613 - DNA, 1091 bp, Homo sapiens; identical to SEQ ID NO: 169611
  Payload ID: 13400
  Gene Symbol: PRB3
  Gene Name: proline-rich protein BstNI subfamily 3
  ENST ID: ENST00000617491
  CDS Start-End: 39-968

SEQ ID NO: 169614 - DNA, 1058 bp, Homo sapiens
  Payload ID: 13400
  Gene Symbol: PRB3
  Gene Name: proline-rich protein BstNI subfamily 3
  ENST ID: ENST00000617030
  CDS Start-End: 39-968
agcacagagttgggagtgactccagagcctccagcaagatgctactgattctgctgtcggtggccctgctggccctgagctcagctcagagcttaaatgaagatgtcagccaggaagaatctccctccgtaatatcaggaaagccagaaggacgacgcccacaaggaggaaaccagccccaacgtaccccacctcctccaggaaagccagaaggacgacccccacaaggaggcaaccagtcccaaggtcccccacctcgtccaggaaagccagaaggaccacccccacaaggaggaaaccagtcccaaggtcccccacctcgtccgggaaagccagaaggacaacccccacaaggaggaaaccagtcccaaggtcccccacctcgtccgggaaagccagaaggaccacccccacaaggaggaaaccagtcccaaggtcccccgcctcgtccgggaaagccagaaggaccacccccacaaggaggaaaccagtcccaaggtcccccgcctcatccgggaaagccagaaggaccacccccacaaggaggaaaccagtcccaaggtcccccacctcgtccgggaaagccagaaggaccacccccacaaggaggaaaccagtcccaaggtcccccacctcgtccgggaaagccagaaggaccacccccacaaggaggaaaccagtcccaaggtcccccacctcgtccaggaaagccagaaggaccaccttcacaaggaggcaacaaacctcaaggtcccccacctcatccaggaaagccacaaggaccacccccacaagaaggtaacaaacctcaacgtccccctcctccaggaaggccacaaggaccacccccaccaggaggcaatccccagcagcctctgccacctcccgctggaaagccccagggaccacctccacctcctcaagggggcagaccacacagacctccccagggacagcctccccagtaatcaaggttcaatgacaggaagtgaacaagaagatgacagtgattcaaatgattcaaatgccatgacattggaagaaggtggtcatagctc

SEQ ID NO: 169615 - DNA, 1283 bp, Homo sapiens; identical to SEQ ID NO: 169612
  Payload ID: 13400
  Gene Symbol: PRB3
  Gene Name: proline-rich protein BstNI subfamily 3
  ENST ID: ENST00000632935
  CDS Start-End: 137-1192

SEQ ID NO: 169616 - DNA, 916 bp, Homo sapiens
  Payload ID: 13401
  Gene Symbol: PRB4
  Gene Name: proline-rich protein BstNI subfamily 4
  ENST ID: ENST00000279575
  CDS Start-End: 38-781
gcacagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggtaccccacctcctccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacaggaagtgaataagaagatatcagtgaattcaaataattcaattgctacaaatgccgtgacattggaacaaggtcatcatagctctaactttaatataccaataaaataatcagcttgc

SEQ ID NO: 169617 - DNA, 586 bp, Homo sapiens
  Payload ID: 13401
  Gene Symbol: PRB4
  Gene Name: proline-rich protein BstNI subfamily 4
  ENST ID: ENST00000445719
  CDS Start-End: 38-574
gcacagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaa

SEQ ID NO: 169618 - DNA, 796 bp, Homo sapiens
  Payload ID: 13401
  Gene Symbol: PRB4
  Gene Name: proline-rich protein BstNI subfamily 4
  ENST ID: ENST00000535904
  CDS Start-End: 35-778
cagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggtaccccacctcctccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacag

SEQ ID NO: 169619 - DNA, 916 bp, Homo sapiens; identical to SEQ ID NO: 169616
  Payload ID: 13401
  Gene Symbol: PRB4
  Gene Name: proline-rich protein BstNI subfamily 4
  ENST ID: ENST00000619196
  CDS Start-End: 38-781

SEQ ID NO: 169620 - DNA, 709 bp, Homo sapiens
  Payload ID: 13401
  Gene Symbol: PRB4
  Gene Name: proline-rich protein BstNI subfamily 4
  ENST ID: ENST00000621732
  CDS Start-End: 38-574
gcacagagttgggagtgactccagagcctccagcgagatgctgctgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacaggaagtgaataagaagatatcagtgaattcaaataattcaattgctacaaatgccgtgacattggaacaaggtcatcatagctctaactttaatataccaataaaataatcagcttgc

SEQ ID NO: 169621 - DNA, 912 bp, Homo sapiens
  Payload ID: 13401
  Gene Symbol: PRB4
  Gene Name: proline-rich protein BstNI subfamily 4
  ENST ID: ENST00000610506
  CDS Start-End: 23-829
tgactccagagcctcctgcaagatgctgttgattctgctgtcagtggccttgctggccctgagctcagctcagaacttaaatgaagatgtcagccaggaagaatctccctccctaatagcaggaaaaccacaaggaccacccccacaaggaggtaaccagccccaaggtcccccacctcctccaggaaagccacaaggaccacccccacaaggaggcaaccagccccaaggtcccccacctcctccaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggcacctcctgctggaaagccccaggggccacctccacctcctcaagggggcaggccacccagacctgcccagggacaacagcctccccagtaatctaggattcaatgacaggaagtgaataagaagatatcagtgaattcaaataattcaattgctacaaatgccgtgacattgga

SEQ ID NO: 169622 - DNA, 796 bp, Homo sapiens; identical to SEQ ID NO: 169618
  Payload ID: 13401
  Gene Symbol: PRB4
  Gene Name: proline-rich protein BstNI subfamily 4
  ENST ID: ENST00000634055
  CDS Start-End: 35-778

SEQ ID NO: 169623 - DNA, 586 bp, Homo sapiens; identical to SEQ ID NO: 169617
  Payload ID: 13401
  Gene Symbol: PRB4
  Gene Name: proline-rich protein BstNI subfamily 4
  ENST ID: ENST00000632467
  CDS Start-End: 38-574

SEQ ID NO: 169624 - DNA, 603 bp, Homo sapiens; identical to SEQ ID NO: 169475
  Payload ID: 13402
  Gene Symbol: PRH1
  Gene Name: proline-rich protein HaeIII subfamily 1
  ENST ID: ENST00000428168
  CDS Start-End: 39-539

SEQ ID NO: 169625 - DNA, 710 bp, Homo sapiens
  Payload ID: 13402
  Gene Symbol: PRH1
  Gene Name: proline-rich protein HaeIII subfamily 1
  ENST ID: ENST00000543626
  CDS Start-End: 37-600
cacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcctagatgaggagcgtcagggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagataacagtgtttcaaatgccgtgaaacatggcatcatgctctaacttcagtataccaataaaacaatcagcttgcaa

SEQ ID NO: 169626 - DNA, 603 bp, Homo sapiens; identical to SEQ ID NO: 169475
  Payload ID: 13402
  Gene Symbol: PRH1
  Gene Name: proline-rich protein HaeIII subfamily 1
  ENST ID: ENST00000543480
  CDS Start-End: 39-539

SEQ ID NO: 169627 - DNA, 675 bp, Homo sapiens
  Payload ID: 13402
  Gene Symbol: PRH1
  Gene Name: proline-rich protein HaeIII subfamily 1
  ENST ID: ENST00000538332
  CDS Start-End: 1-423
ggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacagggaatctcagtctttgaggagattttaatctcacatgcaaattcagtggcttagtcagcttccccaccctgcaacttcttcctacaaacttcctagaggaagaccatcagcctggagactattcgctgtaaagattataacggtgagaataagctctaaaataaaacttcttgttgtgctttacctgacttttctgaagcaaggacacccattctcccagaaaacccaaaggaa

SEQ ID NO: 169628 - DNA, 837 bp, Homo sapiens
  Payload ID: 13402
  Gene Symbol: PRH1
  Gene Name: proline-rich protein HaeIII subfamily 1
  ENST ID: ENST00000539853
  CDS Start-End: 297-824
aggttctccagcatttggctcaaggccccaagggcacatgtgacaagaaggcgccagctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagggagctgacacgtttctcccagcacaaagttgggagtgacaccagagcctcctgcaagatgcttctgattctgctgtcagtggccctgctggccttcagctcagctcaggatttaaatgaagatggaggagactctgagcagttcctagatgaggagcgtcagggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaat

SEQ ID NO: 169629 - DNA, 675 bp, Homo sapiens; identical to SEQ ID NO: 169627
  Payload ID: 13402
  Gene Symbol: PRH1
  Gene Name: proline-rich protein HaeIII subfamily 1
  ENST ID: ENST00000633939
  CDS Start-End: 1-423

SEQ ID NO: 169630 - DNA, 837 bp, Homo sapiens
  Payload ID: 13402
  Gene Symbol: PRH1
  Gene Name: proline-rich protein HaeIII subfamily 1
  ENST ID: ENST00000633091
  CDS Start-End: 297-824
aggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagggagctgacacgtttctcccagcacaaagttgggagtgacaccagagcctcctgcaagatgcttctgattctgctgtcagtggccctgctggccttcagctcagctcaggatttaaatgaagatggaggagactctgagcagttcctagatgaggagcgtcagggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaat

SEQ ID NO: 169631 - DNA, 710 bp, Homo sapiens; identical to SEQ ID NO: 169625
  Payload ID: 13402
  Gene Symbol: PRH1
  Gene Name: proline-rich protein HaeIII subfamily 1
  ENST ID: ENST00000633511
  CDS Start-End: 37-600

SEQ ID NO: 169632 - DNA, 641 bp, Homo sapiens
  Payload ID: 13403
  Gene Symbol: PRH2
  Gene Name: proline-rich protein HaeIII subfamily 2
  Uniprot ID: P02810
  ENST ID: ENST00000381847
  CDS Start-End: 39-539
agcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgataggtatgattccagtttattatccatcaaaggctccaactgctacagttctccaacttcattgtgccagtgaatctattgaaaagc

SEQ ID NO: 169633 - DNA, 673 bp, Homo sapiens
  Payload ID: 13403
  Gene Symbol: PRH2
  Gene Name: proline-rich protein HaeIII subfamily 2
  Uniprot ID: P02810
  ENST ID: ENST00000396400
  CDS Start-End: 39-539
agcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgataggaagtgaataagaagatgacagtgtttcaaatgccttgaaacataatgtgatcatgctctaacttcaatataccaataaaataatcagcttgcaatttctgattatagcatctcct

SEQ ID NO: 169634 - DNA, 673 bp, Homo sapiens; identical to SEQ ID NO: 169633
  Payload ID: 13403
  Gene Symbol: PRH2
  Gene Name: proline-rich protein HaeIII subfamily 2
  Uniprot ID: P02810
  ENST ID: ENST00000572141
  CDS Start-End: 39-539

SEQ ID NO: 169635 - DNA, 641 bp, Homo sapiens; identical to SEQ ID NO: 169632
  Payload ID: 13403
  Gene Symbol: PRH2
  Gene Name: proline-rich protein HaeIII subfamily 2
  Uniprot ID: P02810
  ENST ID: ENST00000575657
  CDS Start-End: 39-539

SEQ ID NO: 169636 - DNA, 641 bp, Homo sapiens; identical to SEQ ID NO: 169632
  Payload ID: 13403
  Gene Symbol: PRH2
  Gene Name: proline-rich protein HaeIII subfamily 2
  Uniprot ID: P02810
  ENST ID: ENST00000622570
  CDS Start-End: 39-539

SEQ ID NO: 169637 - DNA, 673 bp, Homo sapiens; identical to SEQ ID NO: 169633
  Payload ID: 13403
  Gene Symbol: PRH2
  Gene Name: proline-rich protein HaeIII subfamily 2
  Uniprot ID: P02810
  ENST ID: ENST00000622848
  CDS Start-End: 39-539

SEQ ID NO: 169638 - DNA, 1909 bp, Homo sapiens
  Payload ID: 13404
  Gene Symbol: PRRT1
  Gene Name: proline-rich transmembrane protein 1
  Uniprot ID: Q99946
  ENST ID: ENST00000211413
  CDS Start-End: 126-1046
cgccgctgccttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgattta

SEQ ID NO: 169639 - DNA, 1726 bp, Homo sapiens
  Payload ID: 13404
  Gene Symbol: PRRT1
  Gene Name: proline-rich transmembrane protein 1
  Uniprot ID: Q99946
  ENST ID: ENST00000375150
  CDS Start-End: 186-863
atctgactctgtggagcctgggactggtttcagcgagagcctctgtactgctctgtagtctctgctaggacatggacgaaaagggacgcagccgggagagcgactgccccagtcccacccgcctcgcctggtctagcctccgtgtttccatgacaactccaaaggaacccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgattta

SEQ ID NO: 169640 - DNA, 1726 bp, Homo sapiens
  Payload ID: 13404
  Gene Symbol: PRRT1
  Gene Name: proline-rich transmembrane protein 1
  Uniprot ID: Q99946
  ENST ID: ENST00000383309
  CDS Start-End: 186-863
atctgactctgtggagcctgggactggtttcagcgagagcctctgtactgctctgtagtctctgctaggacatggacgaaaagggacgcagccgggagagcgactgccccagtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgattta

SEQ ID NO: 169641 - DNA, 1909 bp, Homo sapiens; identical to SEQ ID NO: 169638
  Payload ID: 13404
  Gene Symbol: PRRT1
  Gene Name: proline-rich transmembrane protein 1
  Uniprot ID: Q99946
  ENST ID: ENST00000454112
  CDS Start-End: 126-1046

SEQ ID NO: 169642 - DNA, 497 bp, Homo sapiens
  Payload ID: 13404
  Gene Symbol: PRRT1
  Gene Name: proline-rich transmembrane protein 1
  ENST ID: ENST00000439937
  CDS Start-End: 310-497
agcgttcgggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcagaacacgaagtttgcattccccaaggggcggccagggggcggaccagggaaaggtagtcctctgcattttgccgtgtgctggtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccc

SEQ ID NO: 169643 - DNA, 497 bp, Homo sapiens
  Payload ID: 13404
  Gene Symbol: PRRT1
  Gene Name: proline-rich transmembrane protein 1
  ENST ID: ENST00000457819
  CDS Start-End: 310-497
agcgttcgggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcaggacacgaagtttgcattccccaaggggcggccagggggcggaccagggaaaggtagtcctctgcattttgccgtgtgctggtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccc

SEQ ID NO: 169644 - DNA, 497 bp, Homo sapiens; identical to SEQ ID NO: 169642
  Payload ID: 13404
  Gene Symbol: PRRT1
  Gene Name: proline-rich transmembrane protein 1
  ENST ID: ENST00000425067
  CDS Start-End: 310-497

SEQ ID NO: 169645 - DNA, 1726 bp, Homo sapiens; identical to SEQ ID NO: 169640
  Payload ID: 13404
  Gene Symbol: PRRT1
  Gene Name: proline-rich transmembrane protein 1
  Uniprot ID: Q99946
  ENST ID: ENST00000452030
  CDS Start-End: 186-863

SEQ ID NO: 169646 - DNA, 497 bp, Homo sapiens; identical to SEQ ID NO: 169642
  Payload ID: 13404
  Gene Symbol: PRRT1
  Gene Name: proline-rich transmembrane protein 1
  ENST ID: ENST00000419839
  CDS Start-End: 310-497

SEQ ID NO: 169647 - DNA, 497 bp, Homo sapiens
  Payload ID: 13404
  Gene Symbol: PRRT1
  Gene Name: proline-rich transmembrane protein 1
  ENST ID: ENST00000428778
  CDS Start-End: 310-497
agcgttcgggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcagaacacgaagtttgcattccccaaggggcggccagggggcggaccagggaaaggtagtcctctgcattttgccgtgtgctggtcccacccgcctcgcctggtctagcctccgtgtttccatgacaactccaaaggaacccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccc

SEQ ID NO: 169648 - DNA, 1726 bp, Homo sapiens; identical to SEQ ID NO: 169640
  Payload ID: 13404
  Gene Symbol: PRRT1
  Gene Name: proline-rich transmembrane protein 1
  Uniprot ID: Q99946
  ENST ID: ENST00000445122
  CDS Start-End: 186-863

SEQ ID NO: 169649 - DNA, 1909 bp, Homo sapiens; identical to SEQ ID NO: 169638
  Payload ID: 13404
  Gene Symbol: PRRT1
  Gene Name: proline-rich transmembrane protein 1
  Uniprot ID: Q99946
  ENST ID: ENST00000419655
  CDS Start-End: 126-1046

SEQ ID NO: 169650 - DNA, 1909 bp, Homo sapiens; identical to SEQ ID NO: 169638
  Payload ID: 13404
  Gene Symbol: PRRT1
  Gene Name: proline-rich transmembrane protein 1
  Uniprot ID: Q99946
  ENST ID: ENST00000456814
  CDS Start-End: 126-1046

SEQ ID NO: 169651 - DNA, 1909 bp, Homo sapiens; identical to SEQ ID NO: 169638
  Payload ID: 13404
  Gene Symbol: PRRT1
  Gene Name: proline-rich transmembrane protein 1
  Uniprot ID: Q99946
  ENST ID: ENST00000458719
  CDS Start-End: 126-1046

SEQ ID NO: 169652 - DNA, 1909 bp, Homo sapiens; identical to SEQ ID NO: 169638
  Payload ID: 13404
  Gene Symbol: PRRT1
  Gene Name: proline-rich transmembrane protein 1
  Uniprot ID: Q99946
  ENST ID: ENST00000451329
  CDS Start-End: 126-1046

SEQ ID NO: 169653 - DNA, 1909 bp, Homo sapiens; identical to SEQ ID NO: 169638
  Payload ID: 13404
  Gene Symbol: PRRT1
  Gene Name: proline-rich transmembrane protein 1
  Uniprot ID: Q99946
  ENST ID: ENST00000444466
  CDS Start-End: 126-1046

SEQ ID NO: 169654 - DNA, 1726 bp, Homo sapiens; identical to SEQ ID NO: 169640
  Payload ID: 13404
  Gene Symbol: PRRT1
  Gene Name: proline-rich transmembrane protein 1
  Uniprot ID: Q99946
  ENST ID: ENST00000423671
  CDS Start-End: 186-863

SEQ ID NO: 169655 - DNA, 1726 bp, Homo sapiens; identical to SEQ ID NO: 169640
  Payload ID: 13404
  Gene Symbol: PRRT1
  Gene Name: proline-rich transmembrane protein 1
  Uniprot ID: Q99946
  ENST ID: ENST00000418753
  CDS Start-End: 186-863

SEQ ID NO: 169656 - DNA, 1726 bp, Homo sapiens; identical to SEQ ID NO: 169640
  Payload ID: 13404
  Gene Symbol: PRRT1
  Gene Name: proline-rich transmembrane protein 1
  Uniprot ID: Q99946
  ENST ID: ENST00000441129
  CDS Start-End: 186-863

SEQ ID NO: 169657 - DNA, 497 bp, Homo sapiens; identical to SEQ ID NO: 169642
  Payload ID: 13404
  Gene Symbol: PRRT1
  Gene Name: proline-rich transmembrane protein 1
  ENST ID: ENST00000423003
  CDS Start-End: 310-497

SEQ ID NO: 169658 - DNA, 1909 bp, Homo sapiens; identical to SEQ ID NO: 169638
  Payload ID: 13404
  Gene Symbol: PRRT1
  Gene Name: proline-rich transmembrane protein 1
  Uniprot ID: Q99946
  ENST ID: ENST00000414687
  CDS Start-End: 126-1046

SEQ ID NO: 169659 - DNA, 497 bp, Homo sapiens; identical to SEQ ID NO: 169643
  Payload ID: 13404
  Gene Symbol: PRRT1
  Gene Name: proline-rich transmembrane protein 1
  ENST ID: ENST00000444218
  CDS Start-End: 310-497

SEQ ID NO: 169660 - DNA, 1726 bp, Homo sapiens; identical to SEQ ID NO: 169640
  Payload ID: 13404
  Gene Symbol: PRRT1
  Gene Name: proline-rich transmembrane protein 1
  Uniprot ID: Q99946
  ENST ID: ENST00000425739
  CDS Start-End: 186-863

SEQ ID NO: 169661 - DNA, 497 bp, Homo sapiens; identical to SEQ ID NO: 169642
  Payload ID: 13404
  Gene Symbol: PRRT1
  Gene Name: proline-rich transmembrane protein 1
  ENST ID: ENST00000437574
  CDS Start-End: 310-497

SEQ ID NO: 169662 - DNA, 3002 bp, Homo sapiens
  Payload ID: 13405
  Gene Symbol: PRRT2
  Gene Name: proline-rich transmembrane protein 2
  Uniprot ID: Q7Z6L0
  ENST ID: ENST00000300797
  CDS Start-End: 177-1076
ctagctgacttgctccctcccgggctgcggctgctgcaaaagccagcagcggcagcgggagctgtccggaggccggcgtcgaggtgagacccgggcagactgaggctgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgag

SEQ ID NO: 169663 - DNA, 2567 bp, Homo sapiens
  Payload ID: 13405
  Gene Symbol: PRRT2
  Gene Name: proline-rich transmembrane protein 2
  Uniprot ID: Q7Z6L0
  ENST ID: ENST00000358758
  CDS Start-End: 302-1324
gtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgaga

SEQ ID NO: 169664 - DNA, 564 bp, Homo sapiens
  Payload ID: 13405
  Gene Symbol: PRRT2
  Gene Name: proline-rich transmembrane protein 2
  ENST ID: ENST00000562148
  CDS Start-End: 247-564
atcttccttgccctcctgctcgtagagacgcctccacccggtcctgcctgtctcactggtcccgtctcctcgcagaaccctctccgtttcccccaaatccccgtctcttccaggaatcccggtgaccgttggcgggaggggccggggacttaagaaggaggcgtctctcctggaggcgcgcggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaa

SEQ ID NO: 169665 - DNA, 1470 bp, Homo sapiens
  Payload ID: 13405
  Gene Symbol: PRRT2
  Gene Name: proline-rich transmembrane protein 2
  Uniprot ID: Q7Z6L0
  ENST ID: ENST00000567659
  CDS Start-End: 199-1383
atgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatgg

SEQ ID NO: 169666 - DNA, 2403 bp, Homo sapiens
  Payload ID: 13405
  Gene Symbol: PRRT2
  Gene Name: proline-rich transmembrane protein 2
  Uniprot ID: Q7Z6L0
  ENST ID: ENST00000572820
  CDS Start-End: 127-1149
ggcagcgggagctgtccggaggccggcgtcgaggtgagacccgggcagactgaggctgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgagactcgcctccaa

SEQ ID NO: 169667 - DNA, 3368 bp, Homo sapiens
  Payload ID: 13406
  Gene Symbol: PRRT3
  Gene Name: proline-rich transmembrane protein 3
  Uniprot ID: Q5FWE3
  ENST ID: ENST00000295984
  CDS Start-End: 111-3056
gcgatcggctgcagggacgcgcgcaaggtgaacacgggggctgcggcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctgcagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttcacccagcaggatccagcagcccctgatgttggctcagtacccccagttgaggtggtgtactctcaggagccaggggcccagccagacttggcattggccagaagccttcctcctgctgaggagctgccggttgagacccccaagagggctggcgctgaggtgtcctgggaagtcagctccccaggtcccccgcccaagcaggctgaccttcctgacgctaaggattcaccaggaccccagcccacggatccacccgcctcagaggctcctgatcggccgtctaagccagagagagcagcaatgaatggagcagaccccatctccccccagcgggtgagaggagctgtggaggccccaggcacccccaagtctctcatccctggtccctcagaccctggcccagctgtaaaccgaacagagagccccatgggggccctgcagccagatgaagccgaggagtggccggggcgcccccaaagccatcccccagcacccccagtccaggccccctcgacgtcacgccggggcctcattcgagtcaccacgcagcgagccctgggccagcctccccctccggagcccaccgccagctccatggcttcagccccagcctccagccccccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgagccggcattttgcacagaggccgtgtcttatgcggaatacagggtgggtgtgcatggattcgggcatgaagaacagggagcaggtgccccagactccccaacgtggagtgatgagcctcgcttgtctagattgtcctctttgtgccaaagaaataaacccttaggacttgg

SEQ ID NO: 169668 - DNA, 3761 bp, Homo sapiens
  Payload ID: 13406
  Gene Symbol: PRRT3
  Gene Name: proline-rich transmembrane protein 3
  Uniprot ID: Q5FWE3
  ENST ID: ENST00000412055
  CDS Start-End: 131-3076
atctcggaggatgcggcgcggcgatcggctgcagggacgcgcgcaaggtgaacacgggggctgcggcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctgcagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttcacccagcaggatccagcagcccctgatgttggctcagtacccccagttgaggtggtgtactctcaggagccaggggcccagccagacttggcattggccagaagccttcctcctgctgaggagctgccggttgagacccccaagagggctggcgctgaggtgtcctgggaagtcagctccccaggtcccccgcccaagcaggctgaccttcctgacgctaaggattcaccaggaccccagcccacggatccacccgcctcagaggctcctgatcggccgtctaagccagagagagcagcaatgaatggagcagaccccatctccccccagcgggtgagaggagctgtggaggccccaggcacccccaagtctctcatccctggtccctcagaccctggcccagctgtaaaccgaacagagagccccatgggggccctgcagccagatgaagccgaggagtggccggggcgcccccaaagccatcccccagcacccccagtccaggccccctcgacgtcacgccggggcctcattcgagtcaccacgcagcgagccctgggccagcctccccctccggagcccaccgccagctccatggcttcagccccagcctccagccccccagccaacgccactgcacccccgctacgctggggcccccttcggcgggtcctgagcttctcctgggagctgcacgtctacggggtgggggtactctttctgctgcccgcgttgttggcgctggctgcgctggcagccgccccagcagggccccggctggcattggtggccgcggtgctggtgctcgtggcttcggcgctgcgatccgcctacatgcttaccgacccttacggctcgcaggcgcggctgggcgttcgcgggggcctggtgctctacaacctgcccttccccttgctgcttacggcgctggcagccctgactctgctcggcctgggcgcggggctgccgccaccgctgcaaaacccactcctgctgggagcagtggcgctggtgcatggtgtagggttgctcgcgacagacctgctgtccacatggtctgtgctcaacctcctgacgcagggcttgtcgtgcgcctggggcgcggccgtggctctgggcacgctctgcctgtgccgtcgccgcctgctggacggcccacggggctgggatgccagcccgggccctcggctgttggctgtggcgggcgcgctggggctgctggctagcggcttgcagctggcggctgcgctctggctgtacccgggcccaggccgcgtgggccgcttctcgtgggcctggtggggtgtccacttctggctgcgcctcctggagctgacatgggcgctcgccctggcgttggccgcggtggctgccgcgagacccaggccgcccacggagcacgcttgctgggctaagctgatgcgtctggcgtgcccggcgccgtcaggaaagagcgaggtgccggagcgacccaataactgctatgcagggcccagcaacgttggtgcaggcagcttggacatcagcaagagcctcatccgcaacccggcggagagtgggcagctggccacgcccagttcaggcgcctggggctcggctgcgtcgttgggtcgcggaccccagggtggcccgggactgtcccgcaacggtgtgggaccggcgccatcgctgagcgagctggatctgcggccgccatcgcccatcaacctgagccgcagcatcgacgccgcgctcttccgcgagcacctagtgcgagacagtgtgttccagcgctgcggcctccgcggcctggcctccccgccgcctggaggcgctctgcggccgcgccggggcagccatcccaaagccgagctcgacgacgctggctcctcgctcctccgcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgaggtgggtggaacacgaggtcaggagttcgagatcagcctcctggtctcgaacatagcgaaaccctcgtctctactaaaaatacaaaaaaattagccaggtggcacacgcctgtagtcccagctactcgggaggctgaggcgggagaattgcttgaacagggaggcagaggttgcagtgagccgagaccacgccattgcactccagcctgggtgacaagagtgagactccgtctcaaaaaaaaaaaaaaaaaaaaaaaaaaaaaaggcatccccaggcctctctacctgacggcaacccccgggggacagccaggtttgaactcaccccacccccatgccgttttttgcttttaatatttctatttttttttcagccggcattttgcacagaggccgtgtcttatgcggaatacagggtgggtgtgcatggattcgggcatgaagaacagggagcaggtgccccagactccccaacgtggagtgatgagcctcgcttgtctagattgtcctctttgtgccaaagaaataaacccttaggacttgg

SEQ ID NO: 169669 - DNA, 1475 bp, Homo sapiens
  Payload ID: 13406
  Gene Symbol: PRRT3
  Gene Name: proline-rich transmembrane protein 3
  Uniprot ID: Q5FWE3
  ENST ID: ENST00000411976
  CDS Start-End: 127-1392
cggaggatgcggcgcggcgatcggctgcagggacgcgcgcaaggtgaacacgggggctgcggcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctgcagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttcacccagcaggatccagcagcccctgatgttggctcagtacccccagttgaggtggtgtactctcaggagccaggggcccagccagacttggcattggccagaagccttcctcctgctgaggagctgccggttgagacccccaagagggctggcgctgaggtgtcctgggaagtcagctccccaggtcccccgcccaagcaggctgaccttcctgacgctaaggattcaccaggaccccagcccacggatccacccgcctcagaggctcctgatcggccgtctaagccagagagagcagcaatgaatggagcagaccccatctccccccagcgggtgagaggagctgtggaggccccaggcacccccaagtctctcatccctggtccctcagaccctggcccagctgtaaaccgaacagagagccccatgggggccctgcagccaggtgagagcatggctggggtgtggggagagggagtgctctgtctagtaactgagaacctctgttggggatgtatgggggcggagggtggggaatgaatggagacaatcacctccttaaaggagttgcccagggcctccttcaaacaacctaggataataaattcatactcactgggaaa

SEQ ID NO: 169670 - DNA, 3544 bp, Homo sapiens
  Payload ID: 13407
  Gene Symbol: PRRT4
  Gene Name: proline-rich transmembrane protein 4
  Uniprot ID: C9JH25
  ENST ID: ENST00000446477
  CDS Start-End: 315-3014
cggctgccgcggagccccggcgcgggcggcttcgccggggagcgaggctcggagccaggaggcggcgccgctgggagggagcgcggagtgcggagtgcggagcgcggggcctggccgcccgcctgagagaagcggtgagataccacgaagcgttgcccagctgggcgccagggccgccacgaccgccccttttcggaggctcggcgaggagacctgcctgcgggagagaccccggggagcaggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgccgccgccctcgggagcgccgcgcatcgcccgctgcggcccctgcggctcgcctcgcgcgggctgcacgcctttctcgccgctttcctttccgggctgctgctggcgctctcctgctggggcgggcggcggcggcgggccggggcgcccctgggagggtcgggcttcaagggcgccacacccctgccgcaggggcgcagccccttcgcccctcgggagtcctggcggcgcgcggcgcgcacggccccggtggcgggcaccttcgggctgctgagcggagccctgcagggctatgaggtgctgcacgccctgggctacggcggccaatccggcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagagg

SEQ ID NO: 169671 - DNA, 1789 bp, Homo sapiens
  Payload ID: 13407
  Gene Symbol: PRRT4
  Gene Name: proline-rich transmembrane protein 4
  ENST ID: ENST00000480290
  CDS Start-End: 1-1258
ctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaatcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctct

SEQ ID NO: 169672 - DNA, 814 bp, Homo sapiens
  Payload ID: 13407
  Gene Symbol: PRRT4
  Gene Name: proline-rich transmembrane protein 4
  ENST ID: ENST00000495931
  CDS Start-End: 198-814
cggctgccgcggagccccggcgcgggcggcttcgccggggagcgaggctcggagccaggaggcggcgccgctgggagggagcgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccag

SEQ ID NO: 169673 - DNA, 1887 bp, Homo sapiens
  Payload ID: 13407
  Gene Symbol: PRRT4
  Gene Name: proline-rich transmembrane protein 4
  ENST ID: ENST00000489517
  CDS Start-End: 449-1887
tgccgcggagccccggcgcgggcggcttcgccggggagcgaggctcggagccaggaggcggcgccgctgggagggagcgcggagtgcggagtgcggagcgcggggcctggccgcccgcctggtgagagcgctgcgggccggggctgggccgggggcggctcaggggcagcggggcggcgaggctgcggtctctggactaggcgaggggccgccgggggctggaggtccggatcttcagtcggggcgctgggcacaacagagagaagcggtgagataccacgaagcgttgcccagctgggcgccagggccgccacgaccgccccttttcggaggctcggcgaggagacctgcctgcgggagagaccccggggagcaggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgc

SEQ ID NO: 169674 - DNA, 2313 bp, Homo sapiens
  Payload ID: 13407
  Gene Symbol: PRRT4
  Gene Name: proline-rich transmembrane protein 4
  Uniprot ID: C9JH25
  ENST ID: ENST00000489835
  CDS Start-End: 117-1406
cgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacgggcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagagga

SEQ ID NO: 169675 - DNA, 883 bp, Homo sapiens
  Payload ID: 13407
  Gene Symbol: PRRT4
  Gene Name: proline-rich transmembrane protein 4
  ENST ID: ENST00000464607
  CDS Start-End: 259-883
aggaggcggcgccgctgggagggagcgcggagtgcggagtgcggagcgcggggcctggccgcccgcctgagagaagcggtgagataccacgaagcgttgcccagctgggcgccagggccgccacgaccgccccttttcggaggctcggcgaggagacctgcctgcgggagagaccccggggagcaggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcag

SEQ ID NO: 169676 - DNA, 2897 bp, Homo sapiens
  Payload ID: 13407
  Gene Symbol: PRRT4
  Gene Name: proline-rich transmembrane protein 4
  Uniprot ID: C9JH25
  ENST ID: ENST00000535159
  CDS Start-End: 198-2897
cggctgccgcggagccccggcgcgggcggcttcgccggggagcgaggctcggagccaggaggcggcgccgctgggagggagcgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgccgccgccctcgggagcgccgcgcatcgcccgctgcggcccctgcggctcgcctcgcgcgggctgcacgcctttctcgccgctttcctttccgggctgctgctggcgctctcctgctggggcgggcggcggcggcgggccggggcgcccctgggagggtcgggcttcaagggcgccacacccctgccgcaggggcgcagccccttcgcccctcgggagtcctggcggcgcgcggcgcgcacggccccggtggcgggcaccttcgggctgctgagcggagccctgcagggctatgaggtgctgcacgccctgggctacggcggccaatccggcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtga

SEQ ID NO: 169677 - DNA, 1840 bp, Homo sapiens
  Payload ID: 13408
  Gene Symbol: PSTPIP1
  Gene Name: proline-serine-threonine phosphatase interacting protein 1
  ENST ID: ENST00000379595
  CDS Start-End: 444-1685
ttcctgcgcaggcctcgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccgctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttct

SEQ ID NO: 169678 - DNA, 1349 bp, Homo sapiens
  Payload ID: 13408
  Gene Symbol: PSTPIP1
  Gene Name: proline-serine-threonine phosphatase interacting protein 1
  Uniprot ID: O43586
  ENST ID: ENST00000559295
  CDS Start-End: 1-1194
atgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccggtgaggtccggcttgcggacagcgcagcctctaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttct

SEQ ID NO: 169679 - DNA, 1896 bp, Homo sapiens
  Payload ID: 13408
  Gene Symbol: PSTPIP1
  Gene Name: proline-serine-threonine phosphatase interacting protein 1
  Uniprot ID: O43586
  ENST ID: ENST00000558012
  CDS Start-End: 490-1740
tgtgggcgagggccctgtgcctgccccgggggaggttgcacaaaccttcctgcgcaggcctcgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccgctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctc

SEQ ID NO: 169680 - DNA, 556 bp, Homo sapiens
  Payload ID: 13408
  Gene Symbol: PSTPIP1
  Gene Name: proline-serine-threonine phosphatase interacting protein 1
  ENST ID: ENST00000558870
  CDS Start-End: 1-400
tgacgctggaaggctgcagcatagacgccgacatcgacagtttcatccaggccaagagcacgggcacagagccccccggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctc

SEQ ID NO: 169681 - DNA, 1715 bp, Homo sapiens
  Payload ID: 13408
  Gene Symbol: PSTPIP1
  Gene Name: proline-serine-threonine phosphatase interacting protein 1
  ENST ID: ENST00000559785
  CDS Start-End: 111-1364
accttgcctctgtgtgctcacagccccccagagcacagctgtgtctgctcccagactatgggctccttgagggcaggacctggtttgggtcccagagcagccagggtttgatgaatgacagatgccctagacctggaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccggtgaggtccggcttgcggacagcgcagcctctagctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtct

SEQ ID NO: 169682 - DNA, 611 bp, Homo sapiens
  Payload ID: 13408
  Gene Symbol: PSTPIP1
  Gene Name: proline-serine-threonine phosphatase interacting protein 1
  ENST ID: ENST00000559859
  CDS Start-End: 177-611
acttcctcggaacatcccagtccttgtgacagtagctcactcggccacagcccctgccagcagcccaaagctctgagcgggggactgggcgggatcctggagcctgcagcctctggggacttgagcacggcggtcacagcctgcagggcctctcgctgctttctgactcctcccgaatggccagctgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcg

SEQ ID NO: 169683 - DNA, 656 bp, Homo sapiens
  Payload ID: 13408
  Gene Symbol: PSTPIP1
  Gene Name: proline-serine-threonine phosphatase interacting protein 1
  ENST ID: ENST00000558407
  CDS Start-End: 130-656
caccagcatggccctccatccggggctgccctggctggacagccccccagagcacagctgtgtctgctcccagactatgggctccttgagggcaggacctggtttgggtcccagagcagccagggtttgatgaatgacagatgccctagacctggaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagag

SEQ ID NO: 169684 - DNA, 781 bp, Homo sapiens
  Payload ID: 13408
  Gene Symbol: PSTPIP1
  Gene Name: proline-serine-threonine phosphatase interacting protein 1
  ENST ID: ENST00000559161
  CDS Start-End: 156-781
ctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcagagtcagaacaaagccaggcagtgcaaggactcggccaccgaggcagagcgggtatacaggcagagcattgcgcagctggagaaggtccgggctgagtgggagcaggagcaccggaccac

SEQ ID NO: 169685 - DNA, 756 bp, Homo sapiens
  Payload ID: 13408
  Gene Symbol: PSTPIP1
  Gene Name: proline-serine-threonine phosphatase interacting protein 1
  ENST ID: ENST00000559856
  CDS Start-End: 1-756
gcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagggcatggctgtcccgagacagagtgactgcatggaagtgaagtccccatcatgggagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagcccccc

SEQ ID NO: 169686 - DNA, 1678 bp, Homo sapiens
  Payload ID: 13408
  Gene Symbol: PSTPIP1
  Gene Name: proline-serine-threonine phosphatase interacting protein 1
  ENST ID: ENST00000559750
  CDS Start-End: 403-813
ggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaaggggagcctcccgaggccgcggccctcggctcagaacctcgtgtcccctgcagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagcca

SEQ ID NO: 169687 - DNA, 1962 bp, Homo sapiens
  Payload ID: 13408
  Gene Symbol: PSTPIP1
  Gene Name: proline-serine-threonine phosphatase interacting protein 1
  ENST ID: ENST00000560223
  CDS Start-End: 453-569
gcacaaaccttcctgcgcaggcctcgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttgggcctcccaaagtgctgggattacaagtgtgagccaccgcgcccgactggcaatagaacactttgaggactgcagtcactgaagcagaagggattcccttcttggtcacctcctgaacaattgcccattgacctggaccagctctgagcccactctcctaggcatcaggacatcagactacaggtggtaggaagacccagaacagctgaggatggttcagtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccgctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtgg

SEQ ID NO: 169688 - DNA, 966 bp, Homo sapiens
  Payload ID: 13408
  Gene Symbol: PSTPIP1
  Gene Name: proline-serine-threonine phosphatase interacting protein 1
  ENST ID: ENST00000560796
  CDS Start-End: 419-724
tctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtacagatgagatttcaccatgttggcctggctggtctcgaactcctgacctcagatgatccacccgcctcagccttccaaagtgctgggattacaggcgtgagccgccgcgcccagcactacatttcacttttgttatattctgcaaatatttgtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaagg

SEQ ID NO: 169689 - DNA, 3000 bp, Homo sapiens
  Payload ID: 13409
  Gene Symbol: PSTPIP2
  Gene Name: proline-serine-threonine phosphatase interacting protein 2
  Uniprot ID: Q9H939
  ENST ID: ENST00000409746
  CDS Start-End: 73-1077
agtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtaaagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 169690 - DNA, 2900 bp, Homo sapiens
  Payload ID: 13409
  Gene Symbol: PSTPIP2
  Gene Name: proline-serine-threonine phosphatase interacting protein 2
  Uniprot ID: Q9H939
  ENST ID: ENST00000589328
  CDS Start-End: 70-1008
ggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaacacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtaaagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 169691 - DNA, 2993 bp, Homo sapiens
  Payload ID: 13410
  Gene Symbol: P3H1
  Gene Name: prolyl 3-hydroxylase 1
  Uniprot ID: Q32P28
  ENST ID: ENST00000236040
  CDS Start-End: 42-2456
ggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggtgagagcagctggtgctgtggtgacccgttcccagagcgcccttggtttgcctttctcttccccaaatcccattgccagtggctgagacacgaaaggagcacttgggacaccagctccaacgccctgtcattatggtcacattgccttgtcctccctgggcctgctgtgaacgggatccaggtggggaaagaggtcaagacagggagcgatgctgagttcttggttccctccttgggccccacttcagctgtccttttccagagagtaggacctgctgggaaggagatgagcctggggccattaaggaaccttccttgtcccctgggaagtagcagctgagagatagcgagtgtctggagcggaggcctctctgaatgggcaggggtttgtccttgcaggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggtttttttt

SEQ ID NO: 169692 - DNA, 2585 bp, Homo sapiens
  Payload ID: 13410
  Gene Symbol: P3H1
  Gene Name: prolyl 3-hydroxylase 1
  Uniprot ID: Q32P28
  ENST ID: ENST00000296388
  CDS Start-End: 53-2263
actccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggtttttttt

SEQ ID NO: 169693 - DNA, 654 bp, Homo sapiens
  Payload ID: 13410
  Gene Symbol: P3H1
  Gene Name: prolyl 3-hydroxylase 1
  ENST ID: ENST00000372526
  CDS Start-End: 32-654
ggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatga

SEQ ID NO: 169694 - DNA, 2705 bp, Homo sapiens
  Payload ID: 13410
  Gene Symbol: P3H1
  Gene Name: prolyl 3-hydroxylase 1
  Uniprot ID: Q32P28
  ENST ID: ENST00000397054
  CDS Start-End: 114-2207
atgcgccgcccggcttggaaggtggggcttcgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggttttttttacttggtttgttcagacaatggaaatttgcccattctgtc

SEQ ID NO: 169695 - DNA, 836 bp, Homo sapiens
  Payload ID: 13410
  Gene Symbol: P3H1
  Gene Name: prolyl 3-hydroxylase 1
  ENST ID: ENST00000431412
  CDS Start-End: 1-667
gactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagttccatgtggctggggaagcctcacaatcatggtggaaggcaaagaggagcaagtcacatcttacatggatggcagcaggcaaagagagaacttctgcagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacg

SEQ ID NO: 169696 - DNA, 3509 bp, Homo sapiens
  Payload ID: 13411
  Gene Symbol: P3H2
  Gene Name: prolyl 3-hydroxylase 2
  Uniprot ID: Q8IVL5
  ENST ID: ENST00000319332
  CDS Start-End: 199-2325
cctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcacttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgtctgatttgtttaataaagggaggcttattttaa

SEQ ID NO: 169697 - DNA, 544 bp, Homo sapiens
  Payload ID: 13411
  Gene Symbol: P3H2
  Gene Name: prolyl 3-hydroxylase 2
  ENST ID: ENST00000444866
  CDS Start-End: 133-544
tccacagcctggctccctctcaaccttcccagtcctatcttccccaactctgccgccttccagccaaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcacttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgag

SEQ ID NO: 169698 - DNA, 609 bp, Homo sapiens
  Payload ID: 13411
  Gene Symbol: P3H2
  Gene Name: prolyl 3-hydroxylase 2
  ENST ID: ENST00000426003
  CDS Start-End: 206-609
agctcctcctgcctccaaaggttctctgggccctgtaaaaccacgggctgcacaggaaaggcaggctatatattgttcttcccctggcccagcgccctgatccaatgcccggacacacatccacaccaagttggacgaaaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcacttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgccta

SEQ ID NO: 169699 - DNA, 2963 bp, Homo sapiens
  Payload ID: 13411
  Gene Symbol: P3H2
  Gene Name: prolyl 3-hydroxylase 2
  Uniprot ID: Q8IVL5
  ENST ID: ENST00000427335
  CDS Start-End: 299-1882
agaagaccacagaaatgcctccaggaggcaggctgggatccagggtccaaccaatattcttgtgagagtgtgaagccaaggaacacgaaagaggggaacaccttggctaagaatgtattcgtgacagaggagaaggggaggaacaggaagcctccagctagtcgtttggaatctggcaaccatttctgtcagctttctcattcctagattgatgcagattgcttaattccttgagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcacttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaa

SEQ ID NO: 169700 - DNA, 2632 bp, Homo sapiens
  Payload ID: 13412
  Gene Symbol: P3H3
  Gene Name: prolyl 3-hydroxylase 3
  Uniprot ID: Q8IVL6
  ENST ID: ENST00000290510
  CDS Start-End: 32-2242
tttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcggcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggatagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacacacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacagaaatggcaggggaggaggctgatgctttaaatgaagaggatggtggggttgggaggtataaccctgctcctctctcccagtctgtgcaataaaggtcgtgaagatctctcagcca

SEQ ID NO: 169701 - DNA, 2791 bp, Homo sapiens
  Payload ID: 13413
  Gene Symbol: P3H4
  Gene Name: prolyl 3-hydroxylase family member 4 (non-enzymatic)
  Uniprot ID: Q92791
  ENST ID: ENST00000355468
  CDS Start-End: 468-1781
tctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatgagtcata

SEQ ID NO: 169702 - DNA, 2601 bp, Homo sapiens
  Payload ID: 13413
  Gene Symbol: P3H4
  Gene Name: prolyl 3-hydroxylase family member 4 (non-enzymatic)
  Uniprot ID: Q92791
  ENST ID: ENST00000393928
  CDS Start-End: 285-1598
gcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatg

SEQ ID NO: 169703 - DNA, 571 bp, Homo sapiens
  Payload ID: 13413
  Gene Symbol: P3H4
  Gene Name: prolyl 3-hydroxylase family member 4 (non-enzymatic)
  ENST ID: ENST00000465097
  CDS Start-End: 1-221
agctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggcatggtggcacacacctgtaatcgtagctgaggcaggagaatcgcctgaacccaggaggcggagcttgcagtgagccgagatcgtgccactgcactccagcct

SEQ ID NO: 169704 - DNA, 505 bp, Homo sapiens
  Payload ID: 13413
  Gene Symbol: P3H4
  Gene Name: prolyl 3-hydroxylase family member 4 (non-enzymatic)
  ENST ID: ENST00000590496
  CDS Start-End: 251-505
ttctttcgcgggcacttcgaattctagtcccctccaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgccc

SEQ ID NO: 169705 - DNA, 662 bp, Homo sapiens
  Payload ID: 13413
  Gene Symbol: P3H4
  Gene Name: prolyl 3-hydroxylase family member 4 (non-enzymatic)
  ENST ID: ENST00000592026
  CDS Start-End: 1-662
gcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagtgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgag

SEQ ID NO: 169706 - DNA, 2844 bp, Homo sapiens
  Payload ID: 13414
  Gene Symbol: P4HA1
  Gene Name: prolyl 4-hydroxylase, alpha polypeptide I
  Uniprot ID: P13674
  ENST ID: ENST00000263556
  CDS Start-End: 242-1846
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatctttttt

SEQ ID NO: 169707 - DNA, 2727 bp, Homo sapiens
  Payload ID: 13414
  Gene Symbol: P4HA1
  Gene Name: prolyl 4-hydroxylase, alpha polypeptide I
  Uniprot ID: P13674
  ENST ID: ENST00000307116
  CDS Start-End: 118-1722
agcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaa

SEQ ID NO: 169708 - DNA, 2727 bp, Homo sapiens
  Payload ID: 13414
  Gene Symbol: P4HA1
  Gene Name: prolyl 4-hydroxylase, alpha polypeptide I
  Uniprot ID: P13674
  ENST ID: ENST00000373008
  CDS Start-End: 118-1722
agcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaa

SEQ ID NO: 169709 - DNA, 2844 bp, Homo sapiens
  Payload ID: 13414
  Gene Symbol: P4HA1
  Gene Name: prolyl 4-hydroxylase, alpha polypeptide I
  Uniprot ID: P13674
  ENST ID: ENST00000394890
  CDS Start-End: 242-1846
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatctttttt

SEQ ID NO: 169710 - DNA, 2790 bp, Homo sapiens
  Payload ID: 13414
  Gene Symbol: P4HA1
  Gene Name: prolyl 4-hydroxylase, alpha polypeptide I
  Uniprot ID: P13674
  ENST ID: ENST00000440381
  CDS Start-End: 242-1792
ggggcgctggtgtgatcgagctcacgtagcgagggctgcagtcgcctcctccctggcgctgccatcgcggcctagaggttataaaagggctaacgggctccctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacagaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatctttttt

SEQ ID NO: 169711 - DNA, 2230 bp, Homo sapiens
  Payload ID: 13415
  Gene Symbol: P4HA2
  Gene Name: prolyl 4-hydroxylase, alpha polypeptide II
  Uniprot ID: O15460
  ENST ID: ENST00000166534
  CDS Start-End: 223-1830
ggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaa

SEQ ID NO: 169712 - DNA, 2313 bp, Homo sapiens
  Payload ID: 13415
  Gene Symbol: P4HA2
  Gene Name: prolyl 4-hydroxylase, alpha polypeptide II
  Uniprot ID: O15460
  ENST ID: ENST00000360568
  CDS Start-End: 312-1913
atgaagggcgcgggcggccagctccggctccggctccggctccggctcccgcgaggccgggtagcctgggcgttcccaggggtcgcagaggacggcgaaccccggcggagccaccggagctggggaccaggacgcaggcaggcgtgtggagcgtgaggtggggacgtggcggcggctcaagtgggcggagccccggcagcggcccgaggcggagtcgccaagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaa

SEQ ID NO: 169713 - DNA, 2223 bp, Homo sapiens
  Payload ID: 13415
  Gene Symbol: P4HA2
  Gene Name: prolyl 4-hydroxylase, alpha polypeptide II
  Uniprot ID: O15460
  ENST ID: ENST00000379086
  CDS Start-End: 222-1823
ctggaaacgccgggagctgcgagtgtccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaa

SEQ ID NO: 169714 - DNA, 2563 bp, Homo sapiens
  Payload ID: 13415
  Gene Symbol: P4HA2
  Gene Name: prolyl 4-hydroxylase, alpha polypeptide II
  Uniprot ID: O15460
  ENST ID: ENST00000379100
  CDS Start-End: 565-2166
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctt

SEQ ID NO: 169715 - DNA, 2569 bp, Homo sapiens
  Payload ID: 13415
  Gene Symbol: P4HA2
  Gene Name: prolyl 4-hydroxylase, alpha polypeptide II
  Uniprot ID: O15460
  ENST ID: ENST00000379104
  CDS Start-End: 565-2172
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctt

SEQ ID NO: 169716 - DNA, 568 bp, Homo sapiens
  Payload ID: 13415
  Gene Symbol: P4HA2
  Gene Name: prolyl 4-hydroxylase, alpha polypeptide II
  ENST ID: ENST00000395164
  CDS Start-End: 66-568
gcatttgggttgcagctgggagcttggcagagattctgcctgatgagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatga

SEQ ID NO: 169717 - DNA, 3349 bp, Homo sapiens
  Payload ID: 13415
  Gene Symbol: P4HA2
  Gene Name: prolyl 4-hydroxylase, alpha polypeptide II
  Uniprot ID: O15460
  ENST ID: ENST00000401867
  CDS Start-End: 570-2177
aaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaagagccttacttggagtatttttaagactggaagcttttaccaggttcatcatttcctatgcatcaccttcatgcaggcagagtctggataatgaatgctttagcagcaaaaaagcatcttgggtcttggatttcagacctggtttcaacacttgtgttccctctaagtgtcagtgtccttttctggaaagtagggtaaatagtttctctttgtctcccagagaacatagcacatgtgttcatgattgtaatgctgttataatgtgtacttcatttttaaattttgagataagaattgttcatgatacacagatgtatacttaaaaaaatatgaaggtgagcaggagcacctgtgtcaacaccaagttagaaaagagaacgttttcaagtcagtacctcaggagccccttgggaacccctcctagatcacatctccttcactgcccccagcactttggagataaatcattgtctcatgatgtgtggtactcattcctttgcttgtctttatagttttaccatctatgattagatccctaaataagtagttattctgttttccctgattttgaacttttactaatagaatgagagtaaatatttttgggtatgtggcttcttttgttcaacattgttttaagattcatccgtgttgcttgtgtagctgtaatttgttttaatctttatagtacattcagttttgttaatgcttattgtaggactgtaccataatacaggcagcatgctgctgataaacactggaattgatttca

SEQ ID NO: 169718 - DNA, 1023 bp, Homo sapiens
  Payload ID: 13415
  Gene Symbol: P4HA2
  Gene Name: prolyl 4-hydroxylase, alpha polypeptide II
  ENST ID: ENST00000417528
  CDS Start-End: 411-1023
tccaggtgagcgccccgcccgctcagccgccagatcaaccttagcgctggggcgcgggctggggtcgccaggcggtgcgttctgcccgcgcggggctgagagttaggggccggggccggatccggggccgggggtcgcgccgctagccgccagcagcgcagtccgggccgccaccctgcaccctccgccctgtttctgcacccgtctgggttcttgtgccgccgcccgcaagccttcccgagctcagggtggtgagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaa

SEQ ID NO: 169719 - DNA, 724 bp, Homo sapiens
  Payload ID: 13415
  Gene Symbol: P4HA2
  Gene Name: prolyl 4-hydroxylase, alpha polypeptide II
  ENST ID: ENST00000431054
  CDS Start-End: 17-724
gttgtgaaaatcggaaatgaaaagacagttggtgacaaactcctttctccatcacctccttattggacagaaacgacccaggaatgcgcctcgcacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccaca

SEQ ID NO: 169720 - DNA, 582 bp, Homo sapiens
  Payload ID: 13415
  Gene Symbol: P4HA2
  Gene Name: prolyl 4-hydroxylase, alpha polypeptide II
  ENST ID: ENST00000416053
  CDS Start-End: 278-582
cgtaatgaccaatgtttgacccctagatgccaagatattcatcagcaagatctttaaacaatgcctgtagaatagaaaactcttcataaagatgcttatttaacctctccagtggtcacgagtcttggcaagaaagtctgaagacgggaccagctgcacatgttttaccctaagagcttgctatataaaggatactttctggaaggctggttggtgtgaggattcagtcttgcagccactcgagacatcacttctgttcacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggagga

SEQ ID NO: 169721 - DNA, 427 bp, Homo sapiens
  Payload ID: 13415
  Gene Symbol: P4HA2
  Gene Name: prolyl 4-hydroxylase, alpha polypeptide II
  ENST ID: ENST00000428841
  CDS Start-End: 276-427
aggcagggaaatccgtcagcctccagggacgctctccctacagccccggcgaggggatcgggtcgtggcgacctctccagacgcccaggggctgggcaggagggcgggccaaggcccgcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtgga

SEQ ID NO: 169722 - DNA, 751 bp, Homo sapiens
  Payload ID: 13415
  Gene Symbol: P4HA2
  Gene Name: prolyl 4-hydroxylase, alpha polypeptide II
  ENST ID: ENST00000428369
  CDS Start-End: 312-751
tattggctaagcccgttctgcaccctcccaagggctgggagtcctaggtcttgtccgggcagggtccagcttggagcccattagatgggccattggatcagaaagtcttttctcccccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggaccc

SEQ ID NO: 169723 - DNA, 568 bp, Homo sapiens
  Payload ID: 13415
  Gene Symbol: P4HA2
  Gene Name: prolyl 4-hydroxylase, alpha polypeptide II
  ENST ID: ENST00000418055
  CDS Start-End: 225-568
gacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgtgattgtcattgaatgcctttcagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaa

SEQ ID NO: 169724 - DNA, 866 bp, Homo sapiens
  Payload ID: 13415
  Gene Symbol: P4HA2
  Gene Name: prolyl 4-hydroxylase, alpha polypeptide II
  ENST ID: ENST00000439698
  CDS Start-End: 315-866
ctcactgcagcctcgaactcctgggctcaaggggtcctcccacctcagccttctgagtagtttggactataggtgcatgccgccacagctggctattttttttttcatttttattttttctagagagggggtctcgctatgttgcccagtggtcacgagtcttggcaagaaagtctgaagacgggaccagctgcacatgttttaccctaagagcttgctatataaaggatactttctggaaggctggttggtgtgaggattcagtcttgcagccactcgagacatcacttctgttcacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcat

SEQ ID NO: 169725 - DNA, 819 bp, Homo sapiens
  Payload ID: 13415
  Gene Symbol: P4HA2
  Gene Name: prolyl 4-hydroxylase, alpha polypeptide II
  ENST ID: ENST00000453286
  CDS Start-End: 359-819
gggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagagggga

SEQ ID NO: 169726 - DNA, 2274 bp, Homo sapiens
  Payload ID: 13416
  Gene Symbol: P4HA3
  Gene Name: prolyl 4-hydroxylase, alpha polypeptide III
  Uniprot ID: Q7Z4N8
  ENST ID: ENST00000331597
  CDS Start-End: 47-1681
gccgcgcggccaggactgtctgaggggaagttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacccaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatcatt

SEQ ID NO: 169727 - DNA, 2248 bp, Homo sapiens
  Payload ID: 13416
  Gene Symbol: P4HA3
  Gene Name: prolyl 4-hydroxylase, alpha polypeptide III
  Uniprot ID: Q7Z4N8
  ENST ID: ENST00000427714
  CDS Start-End: 30-1844
gtctgaggggaagttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacccaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatca

SEQ ID NO: 169728 - DNA, 2045 bp, Homo sapiens
  Payload ID: 13416
  Gene Symbol: P4HA3
  Gene Name: prolyl 4-hydroxylase, alpha polypeptide III
  ENST ID: ENST00000525968
  CDS Start-End: 14-328
gcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtgctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatca

SEQ ID NO: 169729 - DNA, 549 bp, Homo sapiens
  Payload ID: 13416
  Gene Symbol: P4HA3
  Gene Name: prolyl 4-hydroxylase, alpha polypeptide III
  ENST ID: ENST00000532689
  CDS Start-End: 1-186
agcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctgggtcttgaaatgcaaataaggaaccacttcacacttcctaggatggatacaattaaaaaacagaaaataagtgtcactacggatgtgaagaaactggaactctcatgcgttgctggtgggaatgtgaaatggtgcagccactgtggaaaacagattggtgatttctcagaaagataaacatagaactgtcatctgacccagttattccactcccaggtatgtatctgaaagaatggaatgatagctgtacacccatggtcatagcagctttattcacaatcgtcaaaaggtggaagca

SEQ ID NO: 169730 - DNA, 2627 bp, Homo sapiens
  Payload ID: 13416
  Gene Symbol: P4HA3
  Gene Name: prolyl 4-hydroxylase, alpha polypeptide III
  Uniprot ID: Q7Z4N8
  ENST ID: ENST00000524388
  CDS Start-End: 21-794
gaagttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacaggtgatggttgtggttagaagcacactgggctcctcagagaaagatgctttgggagcattagaacaattcagcatctccttctgagatgcattgagagtcatgcaaagaggccagcaggccacgggtagctctgccaatgcatggggcatcttgcagccaaagtgggtacaaacaggcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacccaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctgggtcttgaaatgcaaataaggaaccacttcacacttcctaggatggatacaattaaaaaacagaaaataagtgtcactacggatgtgaagaaactggaactctcatgcgttgctggtgggaatgtgaaatggtgcagccactgtggaaaacagattggtgatttctcagaaagataaacatagaactgtcatctgacccagttattccactcccagattaagaagactaaagctgaggcaagtcagataacttgcccagagtcaaaaaattactggaaaagcagtattcaaaactcagttttccgaacttcagagaccttacttttaccatcttaccatgctgtcttctaaacaggtatttatacctttttatatctggattatcttgagcctttccctttcctaaaacttctaacaataagaaaaatactggccagctgcagtggctcacacctataatcttcgcactctgggaggccaaggcaggtggatcacttgaggtcaggagcttgagaccagcctggccaaaatggtgaaactccatctctactaaaaatacaaaaattagctgggcgtggtggtgcatgcctgtaatcccactactggggtgggtgaggcccggaactgcttcaacctgggaggtagaggttgcagtgagccgagattggtcccaccgcactccagcctgggcaacagagtgagactccaattcaaaaaaaaaaaaaaaaaaa

SEQ ID NO: 169731 - DNA, 2603 bp, Homo sapiens
  Payload ID: 13417
  Gene Symbol: P4HB
  Gene Name: prolyl 4-hydroxylase, beta polypeptide
  Uniprot ID: P07237
  ENST ID: ENST00000331483
  CDS Start-End: 224-1750
gtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctg

SEQ ID NO: 169732 - DNA, 1669 bp, Homo sapiens
  Payload ID: 13417
  Gene Symbol: P4HB
  Gene Name: prolyl 4-hydroxylase, beta polypeptide
  ENST ID: ENST00000415593
  CDS Start-End: 1-823
ctttgaaggggaggtcaccaaggagaacctgctggactttatcaaacacaaccagctgccccttgtcatcgagttcaccgagcagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaatttta

SEQ ID NO: 169733 - DNA, 1502 bp, Homo sapiens
  Payload ID: 13417
  Gene Symbol: P4HB
  Gene Name: prolyl 4-hydroxylase, beta polypeptide
  ENST ID: ENST00000439918
  CDS Start-End: 90-1484
aaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggtgacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccg

SEQ ID NO: 169734 - DNA, 505 bp, Homo sapiens
  Payload ID: 13417
  Gene Symbol: P4HB
  Gene Name: prolyl 4-hydroxylase, beta polypeptide
  ENST ID: ENST00000571617
  CDS Start-End: 62-505
ctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagag

SEQ ID NO: 169735 - DNA, 2453 bp, Homo sapiens
  Payload ID: 13417
  Gene Symbol: P4HB
  Gene Name: prolyl 4-hydroxylase, beta polypeptide
  ENST ID: ENST00000575069
  CDS Start-End: 96-260
atttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaaatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 169736 - DNA, 688 bp, Homo sapiens
  Payload ID: 13417
  Gene Symbol: P4HB
  Gene Name: prolyl 4-hydroxylase, beta polypeptide
  ENST ID: ENST00000573778
  CDS Start-End: 65-688
gctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaaca

SEQ ID NO: 169737 - DNA, 943 bp, Homo sapiens
  Payload ID: 13417
  Gene Symbol: P4HB
  Gene Name: prolyl 4-hydroxylase, beta polypeptide
  ENST ID: ENST00000576380
  CDS Start-End: 343-943
ccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaaatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatca

SEQ ID NO: 169738 - DNA, 571 bp, Homo sapiens
  Payload ID: 13417
  Gene Symbol: P4HB
  Gene Name: prolyl 4-hydroxylase, beta polypeptide
  ENST ID: ENST00000574914
  CDS Start-End: 103-571
acccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgt

SEQ ID NO: 169739 - DNA, 571 bp, Homo sapiens
  Payload ID: 13417
  Gene Symbol: P4HB
  Gene Name: prolyl 4-hydroxylase, beta polypeptide
  ENST ID: ENST00000576541
  CDS Start-End: 8-571
gtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaac

SEQ ID NO: 169740 - DNA, 353 bp, Homo sapiens
  Payload ID: 13417
  Gene Symbol: P4HB
  Gene Name: prolyl 4-hydroxylase, beta polypeptide
  ENST ID: ENST00000570907
  CDS Start-End: 3-353
gaatggagacacggcttcccccaaggaatatacagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggcc

SEQ ID NO: 169741 - DNA, 439 bp, Homo sapiens
  Payload ID: 13417
  Gene Symbol: P4HB
  Gene Name: prolyl 4-hydroxylase, beta polypeptide
  ENST ID: ENST00000576390
  CDS Start-End: 65-385
gctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagg

SEQ ID NO: 169742 - DNA, 562 bp, Homo sapiens
  Payload ID: 13417
  Gene Symbol: P4HB
  Gene Name: prolyl 4-hydroxylase, beta polypeptide
  ENST ID: ENST00000576052
  CDS Start-End: 63-562
tctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggttttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacat

SEQ ID NO: 169743 - DNA, 2268 bp, Homo sapiens
  Payload ID: 13418
  Gene Symbol: P4HTM
  Gene Name: prolyl 4-hydroxylase, transmembrane (endoplasmic reticulum)
  Uniprot ID: Q9NXG6
  ENST ID: ENST00000343546
  CDS Start-End: 369-2060
gatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcagcgcgggcacccccgcggcccctcccctgggcgcgcgcgcgacctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 169744 - DNA, 2127 bp, Homo sapiens
  Payload ID: 13418
  Gene Symbol: P4HTM
  Gene Name: prolyl 4-hydroxylase, transmembrane (endoplasmic reticulum)
  Uniprot ID: Q9NXG6
  ENST ID: ENST00000383729
  CDS Start-End: 372-1880
gacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcagcgcgggcacccccgcggcccctcccctgggcgcgcgcgcgacctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaactccgggtcggcgaaacagag

SEQ ID NO: 169745 - DNA, 678 bp, Homo sapiens
  Payload ID: 13418
  Gene Symbol: P4HTM
  Gene Name: prolyl 4-hydroxylase, transmembrane (endoplasmic reticulum)
  ENST ID: ENST00000444213
  CDS Start-End: 1-678
gtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagaggtg

SEQ ID NO: 169746 - DNA, 681 bp, Homo sapiens
  Payload ID: 13418
  Gene Symbol: P4HTM
  Gene Name: prolyl 4-hydroxylase, transmembrane (endoplasmic reticulum)
  ENST ID: ENST00000491739
  CDS Start-End: 1-473
tcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 169747 - DNA, 598 bp, Homo sapiens
  Payload ID: 13418
  Gene Symbol: P4HTM
  Gene Name: prolyl 4-hydroxylase, transmembrane (endoplasmic reticulum)
  ENST ID: ENST00000472796
  CDS Start-End: 1-267
gaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagaggtgagcacctgaagctgttctcactggagcagggggagaagactgggcagggcctccacagaagtccttgtctggggccaagaggacagaatggattaacccatttgggattaagttccatttgttagaccaggattgggacccactgaaagacaggcaattaacaaaggcaaattagccctccttgcaggcacacaatgggcaactggggttagatagagattgagcacttctttctgattagataaatgacctcttatctttgaccccttatctgaccccgtcacagcaggaaaagggtttttaaataaacaactttcttccagggaggagga

SEQ ID NO: 169748 - DNA, 651 bp, Homo sapiens
  Payload ID: 13418
  Gene Symbol: P4HTM
  Gene Name: prolyl 4-hydroxylase, transmembrane (endoplasmic reticulum)
  ENST ID: ENST00000475629
  CDS Start-End: 1-420
gaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgcatcaccagtgtcaccagcagccacagcccctgctccatcactgccttctgtgccttggccttaatgaactgaggttgagggttttatagggctgttcctgcacccagggagccaacagaggagatcctgcaggggtttgcacagctccgaggtgcccggacccacctggtgaggccccaacatgctgactgggctgtttgtttttgattagcacacagcaggggactgtagaggctggaggcacctccactgggcttgcagattactggcacctaataaactgaagaaacctggg

SEQ ID NO: 169749 - DNA, 2905 bp, Homo sapiens
  Payload ID: 13419
  Gene Symbol: PREP
  Gene Name: prolyl endopeptidase
  Uniprot ID: P48147
  ENST ID: ENST00000369110
  CDS Start-End: 194-2326
ctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagattttctaccctagcaaggatggtacgaagattccaatgttcattgtgcataaaaaaggcataaaattggatggctctcatccagctttcttatatggctatggcggcttcaacatatccatcacacccaactacagtgtttccaggcttatttttgtgagacacatgggtggtatcctggcagtggccaacatcagaggaggtggcgaatatggagagacgtggcataaaggtggtatcttggccaacaaacaaaactgctttgatgactttcagtgtgctgctgagtatctgatcaaggaaggttacacatctcccaagaggctgactattaatggaggttcaaatggaggcctcttagtggctgcttgtgcaaatcagagacctgacctctttggttgtgttattgcccaagttggagtaatggacatgctgaagtttcataaatataccatcggccatgcttggaccactgattatgggtgctcggacagcaaacaacactttgaatggcttgtcaaatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatgacaggcttttacttccggtttcttcatattgaggggcaactccagaagtggagttttctgtgagaataaagcatttcacctttctgcaacaagttagttttcaagcagttaagtcatagaatgtttgttagctttgaaaataagttgttcatcca

SEQ ID NO: 169750 - DNA, 961 bp, Homo sapiens
  Payload ID: 13419
  Gene Symbol: PREP
  Gene Name: prolyl endopeptidase
  ENST ID: ENST00000448705
  CDS Start-End: 1-137
gtatcatttatcactgtgatcttaccaaagaggagctggagccaagagttttccgagaggtgaccgtaaaaggaattgatgcttctgattaccagacagtccagctccccaagggtactgagtcttccagaaactgaatcactggttgattgatgatgacgaagaatgtctctgttcctttgcaatgagaggtcaccaatagggcaccaggtgtttatcaaggcccctcccacctggagggctggaccacacaggccacagattaggaatcagaacattgtttgtgaaggaagatgagaataaagagcgctggatgttccccacaatgtttctgtgaaactagggcattattatagcttggtgaattacccttcaattgtctagaaatggtctagatgataggctacatctagatcatgaataaagctttgtttactaaaacaggtggtgggctggatttggtgtagagctatgatttatcagcccctgttctacatcagcagttggcaaactggcctcctgttttattggagaacacatgcccatttgtttacatattgcctgtggttgctttggcacttagagtggttgcaacagaaactctatgtcccagaaggcctgaaatatttaatatatggcctttaagaaaaagtttgcagaatcttcatctatgtaaatagcatttaaaagtacaacattcttgatagacatacagggccgagaagacatacagggtcaagaagctctgtcagacaggcctgaaatccacgtggggcaagtcatttaacctttctgccacagttttttcaactgtaaagtagagattgatagtatctgttttttaggattcctgtgggattattaagagataaggtatattcaagatctggcaatagaatataatctatttttttcaatcaacgttagaaataaatgtaacagacttttagtttcctattta

SEQ ID NO: 169751 - DNA, 3672 bp, Homo sapiens
  Payload ID: 13420
  Gene Symbol: PREPL
  Gene Name: prolyl endopeptidase-like
  Uniprot ID: Q4J6C6
  ENST ID: ENST00000260648
  CDS Start-End: 960-3143
gaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccat

SEQ ID NO: 169752 - DNA, 2315 bp, Homo sapiens
  Payload ID: 13420
  Gene Symbol: PREPL
  Gene Name: prolyl endopeptidase-like
  Uniprot ID: Q4J6C6
  ENST ID: ENST00000378511
  CDS Start-End: 35-2032
cccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctcca

SEQ ID NO: 169753 - DNA, 2308 bp, Homo sapiens
  Payload ID: 13420
  Gene Symbol: PREPL
  Gene Name: prolyl endopeptidase-like
  Uniprot ID: Q4J6C6
  ENST ID: ENST00000378520
  CDS Start-End: 35-2020
cccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcct

SEQ ID NO: 169754 - DNA, 3080 bp, Homo sapiens
  Payload ID: 13420
  Gene Symbol: PREPL
  Gene Name: prolyl endopeptidase-like
  Uniprot ID: Q4J6C6
  ENST ID: ENST00000410081
  CDS Start-End: 463-2646
cattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaa

SEQ ID NO: 169755 - DNA, 5212 bp, Homo sapiens
  Payload ID: 13420
  Gene Symbol: PREPL
  Gene Name: prolyl endopeptidase-like
  Uniprot ID: Q4J6C6
  ENST ID: ENST00000409936
  CDS Start-End: 439-2622
gcagacttcggctggacttgcctgcggtgacacctgctcccctctgagagcttcaggttctccggcctgccttcactggtttgtgtccagagccggactgattctctcaatttgctttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcgtagtcatgatttttggtggaatgttttatcaatttttgaaaattgcctttgtctcatataatgcttttcatattgaactatattttgtctgctattaaatacttccaagcc

SEQ ID NO: 169756 - DNA, 3030 bp, Homo sapiens
  Payload ID: 13420
  Gene Symbol: PREPL
  Gene Name: prolyl endopeptidase-like
  Uniprot ID: Q4J6C6
  ENST ID: ENST00000409272
  CDS Start-End: 318-2501
attcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctggccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccat

SEQ ID NO: 169757 - DNA, 4725 bp, Homo sapiens
  Payload ID: 13420
  Gene Symbol: PREPL
  Gene Name: prolyl endopeptidase-like
  Uniprot ID: Q4J6C6
  ENST ID: ENST00000409411
  CDS Start-End: 216-2132
aaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcgtagtcatgatttttggtggaatgttttatcaatttttgaaaattgcctttgtctcatataatgcttttcatattgaactatattttgtctgctattaaatacttccaagcctga

SEQ ID NO: 169758 - DNA, 4703 bp, Homo sapiens
  Payload ID: 13420
  Gene Symbol: PREPL
  Gene Name: prolyl endopeptidase-like
  Uniprot ID: Q4J6C6
  ENST ID: ENST00000409957
  CDS Start-End: 194-2110
agattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcgtagtcatgatttttggtggaatgttttatcaatttttgaaaattgcctttgtctcatataatgcttttcatattgaactatattttgtctgctattaaatacttccaagcctga

SEQ ID NO: 169759 - DNA, 583 bp, Homo sapiens
  Payload ID: 13420
  Gene Symbol: PREPL
  Gene Name: prolyl endopeptidase-like
  ENST ID: ENST00000444696
  CDS Start-End: 1-213
gaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagct

SEQ ID NO: 169760 - DNA, 5657 bp, Homo sapiens
  Payload ID: 13420
  Gene Symbol: PREPL
  Gene Name: prolyl endopeptidase-like
  Uniprot ID: Q4J6C6
  ENST ID: ENST00000425263
  CDS Start-End: 960-3143
gaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccgtacgttctggacaagcccctggatcaatttttcagcacactaattagcacttatgttctattttatttcattgtttgacagtcttttatacttctgagagatctaatcacttcttgaaagaatgtcaaggagctccattaaacagcaatctactgggggtattt

SEQ ID NO: 169761 - DNA, 660 bp, Homo sapiens
  Payload ID: 13420
  Gene Symbol: PREPL
  Gene Name: prolyl endopeptidase-like
  ENST ID: ENST00000438314
  CDS Start-End: 208-660
cagacttcggctggacttgcctgcggtgacacctgctcccctctgagagcttcaggttctccggcctgccttcactggtttgtgtccagagccggactgattctctcaatttgcatgaagaaactgaggcccggagacacagttaagtgtaggagctaagacctcaacccagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaactt

SEQ ID NO: 169762 - DNA, 602 bp, Homo sapiens
  Payload ID: 13420
  Gene Symbol: PREPL
  Gene Name: prolyl endopeptidase-like
  ENST ID: ENST00000420756
  CDS Start-End: 1-362
acataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaaggtatgttatcaaggccctctcagtggacagattcccgaactagatacatgttgttttcacattttcagtggttgcagcaggtttatgacaaagccacttcacaaatgtcctatctatgggtgagacccaggaggggagggagggacactgtgtcaatcaagagaaatgtctctctcttgtacttgatacgtgagctctgttaaagaaaataatttaatcttaattgttggaagccttctgcctctctctcgaatgaaagtattcttgccataaattgctgacttcacggttaggtaaagatggatagataaagagaagcttaaacagtggcattttactacaaaggccttctatttaattttt

SEQ ID NO: 169763 - DNA, 6273 bp, Homo sapiens
  Payload ID: 13420
  Gene Symbol: PREPL
  Gene Name: prolyl endopeptidase-like
  Uniprot ID: Q4J6C6
  ENST ID: ENST00000426481
  CDS Start-End: 960-3143
gaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggccaggcaaggtggctcaggcccgtaatcctagcactttgggaggcaaggcagacagatcaccagaggtcaggagttcaagaccagcctggccaacatggtgaaacaccatctctactaaaaaatacagaaattacccgggcataatgacgtgcacctgtaatcccagctacttgggaggctgcagcaggagaatcacttgaacccaggaagcagaggctgcagtgtgccgagatcacgccactgcactcgagcatgggtgacggagcaagactgtctcaaaaaaaaaaaaaaacagtgttgagatcctttaagtattattgtgcacatgtgcaaatatttctaagtattaggaatggaattattaggtcaaaagataacttcattttttgtgtttatagctatagctgggttgcaagctttctattatttgcttgctatatcttcattttaattctttgtgttttatgttagtgtttcttatgtctgtttttgttatctgagtggttttatcttttaataggctaatttaacccattcatatttgtaattattgtattatttagacataattcggaagccctattttatttgtagttatactattgtttagggtttttttctattaagctttttgttggattgactgtataatttttttcttctagtattctttgaaaatttgaaaattgttatattttatgtctagtgttctttgaaaataattctttgaaaattatttttatgtcctaattttaccattaaaattatgaccacttga

SEQ ID NO: 169764 - DNA, 6049 bp, Homo sapiens
  Payload ID: 13420
  Gene Symbol: PREPL
  Gene Name: prolyl endopeptidase-like
  Uniprot ID: Q4J6C6
  ENST ID: ENST00000541738
  CDS Start-End: 388-2304
atttccggtactcgcatctccttggcaaccagggccgagctgtcacgccattgcaccattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtaattttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcgtagtcatgatttttggtggaatgttttatcaatttttgaaaattgcctttgtctcatataatgcttttcatattgaactatattttgtctgctattaaatacttccaagcctgatttttgtaattttattttttattcaattacaagaatacatactataaaaaggttttcttcaacacctttccatagcttcacagttcccctcagagacaggcactatatgttcttttgtttttaatgtatcatatgtttgcataggcacagaatgtatcatttcatatgtttatatatttttctttacacagttggtgatatgttaccattctatactttattgaatacctgtttgaaatggtctcatatcaatgtatatagaactgtcatttttaaaagctgcatactgggcccatagttgatagaactggttttctgttgataaaatatttaaatcatttcttgtgtcttctattaaaaacaaattttgcaggccaggcaaggtggctcaggcccgtaatcctagcactttgggaggcaaggcagacagatcaccagaggtcaggagttcaagaccagcctggccaacatggtgaaacaccatctctactaaaaaatacagaaattacccgggcataatgacgtgcacctgtaatcccagctacttgggaggctgcagcaggagaatcacttgaacccaggaagcagaggctgcagtgtgccgagatcacgccactgcactcgagcatgggtgacggagcaagactgtctcaaaaaaaaaaaaaaacagtgttgagatcctttaagtattattgtgcacatgtgcaaatatttctaagtattaggaatggaattattaggtcaaaagataacttcattttttgtgtttatagctatagctgggttgcaagctttctattatttgcttgctatatcttcattttaattctttgtgttttatgttagtgtttcttatgtctgtttttgttatctgagtggttttatcttttaataggctaatttaacccattcatatttgtaattattgtattatttagacataattcggaagccctattttatttgtagttatactattgtttagggtttttttctattaagctttttgttggattgactgtataatttttttcttctagtattctttgaaaatttgaaaattgttatattttatgtctagtgttctttgaaaataattctttgaaaattatttttatgtcctaattttaccattaaaattatgaccacttg

SEQ ID NO: 169765 - DNA, 3090 bp, Homo sapiens
  Payload ID: 13421
  Gene Symbol: PRCP
  Gene Name: prolylcarboxypeptidase (angiotensinase C)
  Uniprot ID: P42785
  ENST ID: ENST00000313010
  CDS Start-End: 196-1686
ctcggggatgggggcggagtggctgtggtgacctggcttgggcggcgtctctgaggagctggctggctttgggtttcccctgggaggagctgttttgcggcgggcggagctgcaggctgggcagggcttagcctgtgcgcttctgctggcctccttttcgccctcccacccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggaccttatacctgtgtgttgcttctgaagctcacttcaactccggctgatggaaatgctgtgtgcactgggcttagctgtttttggaaagtcctttaattttttctcttccacttggcagcttttcttagttctgggatgttggccactgtggtactgccagtaagaaatctggcctttttctgctccatttctctttgtttctaaggtcagttttaatttgtttgaattctgccagtttaggaaaatgactctgttttgtctttttaaatctgagcaagctttatgctgtagtcactaattatatttcagtaagaagcctttaaaaattgatgaatcagctattccaaaagtagaatatagtaatattcagcttttaaatttttaaaattttattttctgatagttgttactgctgtcattaaaaccagaagtgttagacactaacaggcaggtgcacaagaacttttctgtatgacttccaaaagacaagctgactaattcatgcaggcagcatatttgacattaataaatggccaagccattcctatttccaaggggttggcttctttcaagcagttcttacactgagacctttcttcagagagcttttctaggataacaaatagggttggatcaaaacctttcagggacacagagagacagagagagagagactaacagtttctactctgttgaaagatttcttcctccttgtttcttttcattttctctcaataatttttttttcttcaccctgccttgggaacattttctgcttttaaaaaactgtaccttgagcttgatcatttttatggcattttttttttttaagggcatatatagagttcattcttgggatggaaagctgaa

SEQ ID NO: 169766 - DNA, 2120 bp, Homo sapiens
  Payload ID: 13421
  Gene Symbol: PRCP
  Gene Name: prolylcarboxypeptidase (angiotensinase C)
  Uniprot ID: P42785
  ENST ID: ENST00000393399
  CDS Start-End: 29-1582
acccgcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggcccttgctgctgggcagttgcacatatgtattatccaactaaatcattacaagactcctctggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtctttgcaccacgtctaggaagaatcttcttgatagctctcccacaccatcagtggccctcataactggagtagagttcctggttgcttttcataagagggagagttactttctttgtatctctgcaagcagagatttctctttggttttgaggttgaagtgtctttggcccatttgtaagtccccatccctaccctacacaaagtaaaagcagaagatagataaaaaatgatgtaattgcagctggtaggatgtctggtgccaatccaggaagtgagagccatttcttttgtaccggatttaatgactttgaactgtgctgtaaataaataatacagctggacctt

SEQ ID NO: 169767 - DNA, 546 bp, Homo sapiens
  Payload ID: 13421
  Gene Symbol: PRCP
  Gene Name: prolylcarboxypeptidase (angiotensinase C)
  ENST ID: ENST00000531128
  CDS Start-End: 104-546
ttactcagagccaatcagaagaaggcgccgcagagggtggagcttagcgaggaaatcctacaagcatctggaaacgaccattttcgtcaaactgcgggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtgg

SEQ ID NO: 169768 - DNA, 354 bp, Homo sapiens
  Payload ID: 13421
  Gene Symbol: PRCP
  Gene Name: prolylcarboxypeptidase (angiotensinase C)
  ENST ID: ENST00000533126
  CDS Start-End: 226-354
ggagcttcgctgagcctcctgggcgtagggttcccgggaaagtgtggagtgagccgcagcgccctggggtctggcggggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaa

SEQ ID NO: 169769 - DNA, 783 bp, Homo sapiens
  Payload ID: 13421
  Gene Symbol: PRCP
  Gene Name: prolylcarboxypeptidase (angiotensinase C)
  ENST ID: ENST00000534631
  CDS Start-End: 206-783
gagggtggagcttagcgaggaaatcctacaagcatctggaaacgaccattttcgtcaaactgcgggtagagtctttctccccgacaggtggatcagtagtacagtccgtaaaattggttttggagcttcgctgagcctcctgggcgtagggttcccgggaaagtgtggagtgagccgcagcgccctggggtctggcggggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaacttttt

SEQ ID NO: 169770 - DNA, 936 bp, Homo sapiens
  Payload ID: 13421
  Gene Symbol: PRCP
  Gene Name: prolylcarboxypeptidase (angiotensinase C)
  ENST ID: ENST00000531801
  CDS Start-End: 236-936
agagggtggagcttagcgaggaaatcctacaagcatctggaaacgaccattttcgtcaaactgcgggtagagtctttctccccgacaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcggg

SEQ ID NO: 169771 - DNA, 737 bp, Homo sapiens
  Payload ID: 13421
  Gene Symbol: PRCP
  Gene Name: prolylcarboxypeptidase (angiotensinase C)
  ENST ID: ENST00000534396
  CDS Start-End: 302-737
gctcctcaagcgcggccagaatggacggcgaggccgaggaggcaccgagagcgagcgacgctgcgcgggctgccagcatgctgtcacctctcaatatgatcttataagaaagtagaggccatggagatacaatatctacttcacgggattttatgttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactg

SEQ ID NO: 169772 - DNA, 611 bp, Homo sapiens
  Payload ID: 13421
  Gene Symbol: PRCP
  Gene Name: prolylcarboxypeptidase (angiotensinase C)
  ENST ID: ENST00000529671
  CDS Start-End: 121-611
gagatgatgcgtgtgcctccctgcctcgtgatacactggcctgtagtgaaccttcaataaattgtcatggtagctgttattgccgttacgtaggatttgcggaaggcaggaggtgtcgcaatggaattgcggtggccagggcagggtttggtggtgatgataatggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccc

SEQ ID NO: 169773 - DNA, 491 bp, Homo sapiens
  Payload ID: 13421
  Gene Symbol: PRCP
  Gene Name: prolylcarboxypeptidase (angiotensinase C)
  ENST ID: ENST00000528082
  CDS Start-End: 193-491
gcttcgctgagcctcctgggcgtagggttcccgggaaagtgtggagttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccc

SEQ ID NO: 169774 - DNA, 574 bp, Homo sapiens
  Payload ID: 13421
  Gene Symbol: PRCP
  Gene Name: prolylcarboxypeptidase (angiotensinase C)
  ENST ID: ENST00000534264
  CDS Start-End: 496-574
agattcccgttctgttattctgtgaaaccacagaggctgccttgtctcttttctccttttggtgtgactttcattttatgtgaaggccacagggtaacttaccctgtccagtgatttttccagtttccattctcttgtattataggcaggtagctgttcctgcctccactaggcactactctgacaggcactgtggcagaacttaaggtttgctggggtatctctgttctcgaaagtggtggaaaggaagagatattcagtgtaggaacagttctgaagaactgactagaggcagatcatagaagagcagatcctggcccatccgcagccccagagaccttcctttacataccaaaatgttccagtgcacattcactgctggacattaatttgttgagaggcagcatcacacagtggtcgagagtgaaggcttcagtcagatagacaaggtttgaatgctgattttgccactttgctgtgtgactttaggggttcatgtgggatgtggctgaggaactgaaagctatgttggtgtttgctgaacatcgatactatggagagtctctcccctttg

SEQ ID NO: 169775 - DNA, 845 bp, Homo sapiens
  Payload ID: 13421
  Gene Symbol: PRCP
  Gene Name: prolylcarboxypeptidase (angiotensinase C)
  ENST ID: ENST00000527444
  CDS Start-End: 296-845
caatcgaatctcccgcgtccttttccgccggaagtaacgctttggctctgattactcagagccaatcagaagaaggcgccgcagagggtggagcttagcgaggaaatcctacaagcatctggaaacgaccattttcgtcaaactgcgggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatgg

SEQ ID NO: 169776 - DNA, 525 bp, Homo sapiens
  Payload ID: 13421
  Gene Symbol: PRCP
  Gene Name: prolylcarboxypeptidase (angiotensinase C)
  ENST ID: ENST00000532809
  CDS Start-End: 177-525
gtcgcaatggaattgcggtggccagggcagggtttggtggtgatgataatggtagggatattgggtgacctgaaggacaggtgggcttcgggggcgctatagataaagcatgggctacagcgatgagttaggaagaggccctagcatgataagggcagacttggggtgtgaccgcaatgaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatc

SEQ ID NO: 169777 - DNA, 2347 bp, Homo sapiens
  Payload ID: 13422
  Gene Symbol: PARS2
  Gene Name: prolyl-tRNA synthetase 2, mitochondrial (putative)
  Uniprot ID: Q7L3T8
  ENST ID: ENST00000371279
  CDS Start-End: 84-1511
gcgcgctggcccggcacggcggtggtcttgcgggaggcgtgggctgggattgcggtgcctgtgcttcccggtgccagggtgtcatggaagggctgctgacaagatgcagagcattgcccgccctggccacctgcagccgccagctctctgggtatgttccttgcaggtttcaccactgtgccccaagaagagggcggcgcctgctgctgtctcgtgtgttccagccacagaaccttcgggaagaccgggtgctctccctgcaggacaaatctgatgacctgacctgtaagagccagcggctgatgctgcaggtgggcctgatctacccagcaagccccggctgttaccacctcctgccatataccgtccgtgccatggagaagctcgtgcgagtgatagaccaggagatgcaggccatcgggggccagaaagtcaacatgcccagcctcagcccggcagagctctggcaagccaccaaccggtgggacttgatgggcaaagagctgctaagacttagagacaggcatggcaaggaatactgcttaggaccaactcacgaggaagccattacggccttaattgcctcccagaagaaactgtcctacaagcagcttcccttcctgctgtaccaagtgacaaggaagtttcgggatgagcccaggccccgctttggtcttctccgtggccgagagttttacatgaaggatatgtacacctttgactcctccccagaggctgcccagcagacctacagcctggtgtgtgatgcctactgcagcctgttcaacaagctagggctgccatttgtcaaggtccaggccgatgtgggcaccatcgggggcacagtgtctcatgagttccagctcccagtggatattggagaggaccggcttgccatctgtccccgctgcagcttctcagccaacatggagacactagacttgtcacaaatgaactgccctgcttgccagggcccattgactaaaaccaaaggcattgaggtggggcacacattttacctgggtaccaagtactcatccattttcaatgcccagtttaccaatgtctgtggcaaaccaaccctggctgaaatggggtgctatggcttgggtgtgacacggatcttggctgctgccattgaagtcctctctacagaagactgtgtccgctggcccagcctactggccccttaccaagcctgcctcatcccccctaagaagggcagtaaggagcaggcggcctccgagctcatagggcagctgtacgaccacatcacagaggcagtgcctcagcttcacggggaggtgctcctggacgacaggacccatctgaccatcggaaacagactgaaagatgccaacaagtttggctacccctttgtgataatcgctggcaagagggccctggaggaccctgcacattttgaggtttggtgtcagaacactggtgaggtggccttcctcaccaaagatggagtcatggatttactgaccccagtgcagactgtctaaatgcccccagcccacccctgcccccatttgcagccttggtgttcgttctaacactgcattttcctacacccctttcctggactgctctctccagaaacagcacagctcatggagggtgagatcatgttagggaaatcaatttttatctagtcatttgttcagattatttgtatttaaagtcattaacttgatccctttctccagactggccatgccgccatatacctttccttttgtattccattgtggaagcttctaggaggctgagaagcaggagatccaagctccagtcctgggtgttaccctgaggggggaagtcacttcccttctctcagctgagtttttcacgtgtaagatgagaatggctgatggctgagagcccaccaaccttccccaccccgtatcagtttgaccacgggccttttgctacattctatccagagagcaggcctgccagcccctctccactgagaagttgggctgagagtatggggaaaagaatcaagagacctgactgccgccaactcactagtgacttagatacatcccctccccctgctggggcctcagtttccccatctgtaacttgagaaaatagaactagatctgtaaagtctggaactagatctgtaacgtccttataggtgtcactagggggttccatgagaggtgtgtgacaggcagtctgattcctctcattctccatagtctgtttcctggaaagtcgatgtaattaactgatggcccaaaaactacctcaagagacctggccctgttaagacggcttaaccactgagatcccgttctattgatttaataaagtcaaactattggaa

SEQ ID NO: 169778 - DNA, 766 bp, Homo sapiens
  Payload ID: 13423
  Gene Symbol: PMCH
  Gene Name: pro-melanin-concentrating hormone
  Uniprot ID: P20382
  ENST ID: ENST00000329406
  CDS Start-End: 76-573
cgtttaccaagcaggctgacagagaaatttttcattttctttcttgtttgactgtatgcaaacatcaaactaagaatggcaaaaatgaatctctcttcctatatattaatactaactttttctttgttttctcaaggtattttactttcagcatccaagtccataagaaatttagatgatgacatggtatttaatacattcaggttggggaaaggctttcagaaggaagacactgcagaaaaatcagttattgctccttccctggaacaatataaaaatgatgagagcagtttcatgaacgaagaggaaaataaagtttcaaagaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatgctcagatgtatgctgggaagagtctaccgaccttgttggcaagtctgatacctgttggtccacatcatcttttcagaagaaaataaaagcatttaattgccaatgggaggagaagcccatactgctactataacttgtgtatgttaaatgtctgttttaaaagaaagtagtgttaagatgtatcagtaactgaaatgatatgctttctctgtgcattaaactttgtgaaaattctgcataa

SEQ ID NO: 169779 - DNA, 3977 bp, Homo sapiens
  Payload ID: 13424
  Gene Symbol: PROM1
  Gene Name: prominin 1
  Uniprot ID: O43490
  ENST ID: ENST00000447510
  CDS Start-End: 213-2810
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 169780 - DNA, 567 bp, Homo sapiens
  Payload ID: 13424
  Gene Symbol: PROM1
  Gene Name: prominin 1
  ENST ID: ENST00000508940
  CDS Start-End: 447-567
agaggaactgcggggagagcgtggtggtgccggtgcccgtccaacccaaactttttagtctgagtggtggcccgcgacgccccgcttgggtcttctttccatccactggggatgggggcgggggtgggggtagccggcggccgtggttccggagcgggagtcggaggtgagtgtgcgaactggaccggggccccagagacttcggactcgctctcggggagaacggtgaccgagggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaatt

SEQ ID NO: 169781 - DNA, 568 bp, Homo sapiens
  Payload ID: 13424
  Gene Symbol: PROM1
  Gene Name: prominin 1
  ENST ID: ENST00000514967
  CDS Start-End: 526-568
attcttttgtgtcccgcagctcgcgagaggcttccgcccagaagggagctaggcctggagggggcttggcctggaggtggtttggagggagggcactgaagggacagtgtcttgatgtcatagttagatcttggactttgaaggcaaactagtgggtttgactcttggccacatggttaatcacctgtgaccttgggcaagtcaccagaatcctctctgtgtcagtttcctcatctgcaaaatggaataatgccttaaacaaggaggaccttgtttctatctatgaagcatggagaacagtgcctggaagataggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcg

SEQ ID NO: 169782 - DNA, 622 bp, Homo sapiens
  Payload ID: 13424
  Gene Symbol: PROM1
  Gene Name: prominin 1
  ENST ID: ENST00000503884
  CDS Start-End: 1-197
ctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtttggcaccacttcttggaagcttcctctgctccccacctggggtgatgccctcttctggaaggctctcactgctacacacacagtggctgccgaagctcagcctggctttagttccagccctactaggtcttctcaggactcaggatatccaggtggaaggaaggctgtgccagagttgcaagcaagtttatcggagtatcgccatgaagttcgtcccctgcctcctgctggtgaccttgtcctgcctggggactttg

SEQ ID NO: 169783 - DNA, 1595 bp, Homo sapiens
  Payload ID: 13424
  Gene Symbol: PROM1
  Gene Name: prominin 1
  ENST ID: ENST00000511153
  CDS Start-End: 1-163
ccaagactcccataaagctggacccattggcattctctttgaactagtgcatatctttctctatgtggtacagccgcgtgatttcccagaagatgagaacacaaaggcccagataggagaagcctgctcatttaagaccctgcagccaaatgagagctggtaggataacgaagccagaaagaggacaaggggaatttttgcctgggaggttatctcagcacacaagtgatcctcctgcctcagcctcctgagtagctggaactgtagacgtaagccaccatgaccagcctaatttatcaagaatgatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggtgtgaaggaagtaagccaaactgtgaagaaatcatcatgaagagggaggtgttttgcagtattagttatgatagtgaagcactg

SEQ ID NO: 169784 - DNA, 581 bp, Homo sapiens
  Payload ID: 13424
  Gene Symbol: PROM1
  Gene Name: prominin 1
  ENST ID: ENST00000513946
  CDS Start-End: 1-280
tgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatg

SEQ ID NO: 169785 - DNA, 551 bp, Homo sapiens
  Payload ID: 13424
  Gene Symbol: PROM1
  Gene Name: prominin 1
  ENST ID: ENST00000508322
  CDS Start-End: 379-551
agaggaactgcggggagagcgtggtggtgccggtgcccgtccaacccaaactttttagtctgagtggtggcccgcgacgccccgcttgggtcttctttccatccactggggatgggggcgggggtgggggtagccggcggccgtggttccggagcgggagtcggagggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaact

SEQ ID NO: 169786 - DNA, 4349 bp, Homo sapiens
  Payload ID: 13424
  Gene Symbol: PROM1
  Gene Name: prominin 1
  Uniprot ID: O43490
  ENST ID: ENST00000505450
  CDS Start-End: 614-3184
ctgctgcacactaaggatccaaatgattgtttttttgttttttgttttgttttgttttgttttgttttgttttaaattgcattgggattaggcaacagaagggtctaatgcggccgggatgagacaggagagtttttaggagggtagctgcattctaagtaagggactctgcggggggaaaagaggcgcaagcgttgcaagaagggagtgcagggggttgagcaggcacctctacaggaaatggatgctgtccaggtgctggtgggcgccccagggctacgtggcgaagcagctcagccggtccaatcagagtgcgtccagggctcgggtttcgcgatctttaagtgactgaggcagatccccacgcggcacctggccatgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaaca

SEQ ID NO: 169787 - DNA, 4006 bp, Homo sapiens
  Payload ID: 13424
  Gene Symbol: PROM1
  Gene Name: prominin 1
  Uniprot ID: O43490
  ENST ID: ENST00000510224
  CDS Start-End: 250-2847
gactagggcgggagcaggagcgggagccgggtgcacgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttgg

SEQ ID NO: 169788 - DNA, 4014 bp, Homo sapiens
  Payload ID: 13424
  Gene Symbol: PROM1
  Gene Name: prominin 1
  Uniprot ID: O43490
  ENST ID: ENST00000508167
  CDS Start-End: 281-2851
ggcgagctaagggaagggcggcggcagcggtgactagggcgggagcaggagcgggagccgggtgcacgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaa

SEQ ID NO: 169789 - DNA, 3908 bp, Homo sapiens
  Payload ID: 13424
  Gene Symbol: PROM1
  Gene Name: prominin 1
  Uniprot ID: O43490
  ENST ID: ENST00000540805
  CDS Start-End: 213-2741
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 169790 - DNA, 3884 bp, Homo sapiens
  Payload ID: 13424
  Gene Symbol: PROM1
  Gene Name: prominin 1
  Uniprot ID: O43490
  ENST ID: ENST00000539194
  CDS Start-End: 213-2717
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattacgataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 169791 - DNA, 4728 bp, Homo sapiens
  Payload ID: 13425
  Gene Symbol: PROM2
  Gene Name: prominin 2
  Uniprot ID: Q8N271
  ENST ID: ENST00000317620
  CDS Start-End: 134-2638
gctcaggaacccaaacctgtcgggcaggttttgagagctgtggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctccaggtgtcaccccttacccccatgctggtggcatcctcacaggaagagcctgttctccacctgctggagcctggaccctggggtgggacagaggcctcgtccaaccccactccccttcccgtgtgtcttccccctgccaagcctccccctgccaagcctccccctgcccctctctgagcccctcgccccccacaccgtcctcatctggcctcccccctggcccccacttccctcttatgcccttcctggccctttgcttcctcccttagtcccctcttcaccatatctccactgctaccttgctggccccagagaccaccctgcccaaccaaaccactcaggtaacgccactaatcaggcaggggccaccatggcctaggtctgggctggctgcaggccctgcctcatggcctctgagccctccactgccccagggccttgggccctctgcagatctcatccaggatttattggtgtccagtggggtgagggaggcctgtctgaaggccgagcctccctgcctgcacccaagttagaaatgggggtaccagcacttagcttctctctgagtgctggctcccaaggaagggacctgggacctgggccacagtgggggcttgcccttacctcttcagaaggaagcatcttccacagcccccacccaactttcttaggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttccctgagacttggttctgggtccttaaaaccaggtttcctaggctgggaccctgtacatagttggtgtttaatgagtgtttatggagaggagagttctaaggtcacctctggctgcaggcatccagggattattccagcaatctgcaggtagggagtgggtcccagcctgggagcctgctgtcaggagcaggcagacctggactcacagcctggctgtgatgcttgttcgctcagcttctccatttatgagatggggagaatagtcacagcctcctcaaagggttgtgaaaatcaaatgtgataatttgtggaaagcccttagcagtggcctggcacaaaacaaatgctcagtggatggaagctgcctattattattgtcgttgttgttgtttgccatgactgctctgggccgggggtagagctagcatccgggcatgtacgagggaagagggaggcaggcctctattcaaaggcagaaattcctttaagattgtggtctgctgggtttcagggagtgtctgtgttgtttgtttttgtttgtttgtttgttttgagacagggtctcgctctgtcacccaggctggagtgtagtggtgcagtcttggctcactgcaacctccacctcctgggctcaagcgattctcatgcctcagcctcccgagtagctgggactacaggtgtgtgccactatgcctggctaatttttgtattttttgtagagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaat

SEQ ID NO: 169792 - DNA, 3824 bp, Homo sapiens
  Payload ID: 13425
  Gene Symbol: PROM2
  Gene Name: prominin 2
  Uniprot ID: Q8N271
  ENST ID: ENST00000317668
  CDS Start-End: 134-2638
gctcaggaacccaaacctgtcgggcaggttttgagagctgtggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtgggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttccctgagacttggttctgggtccttaaaaccaggtttcctaggctgggaccctgtacatagttggtgtttaatgagtgtttatggagaggagagttctaaggtcacctctggctgcaggcatccagggattattccagcaatctgcaggtagggagtgggtcccagcctgggagcctgctgtcaggagcaggcagacctggactcacagcctggctgtgatgcttgttcgctcagcttctccatttatgagatggggagaatagtcacagcctcctcaaagggttgtgaaaatcaaatgtgataatttgtggaaagcccttagcagtggcctggcacaaaacaaatgctcagtggatggaagctgcctattattattgtcgttgttgttgtttgccatgactgctctgggccgggggtagagctagcatccgggcatgtacgagggaagagggaggcaggcctctattcaaaggcagaaattcctttaagattgtggtctgctgggtttcagggagtgtctgtgttgtttgtttttgtttgtttgtttgttttgagacagggtctcgctctgtcacccaggctggagtgtagtggtgcagtcttggctcactgcaacctccacctcctgggctcaagcgattctcatgcctcagcctcccgagtagctgggactacaggtgtgtgccactatgcctggctaatttttgtattttttgtagagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaatagaaa

SEQ ID NO: 169793 - DNA, 2922 bp, Homo sapiens
  Payload ID: 13425
  Gene Symbol: PROM2
  Gene Name: prominin 2
  Uniprot ID: Q8N271
  ENST ID: ENST00000403131
  CDS Start-End: 134-2638
gctcaggaacccaaacctgtcgggcaggttttgagagctgtggagagagggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccagggagattgtgcaggggccctgagctgggcccgcaccctggagctgggtgctgacttcagccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaataga

SEQ ID NO: 169794 - DNA, 3767 bp, Homo sapiens
  Payload ID: 13425
  Gene Symbol: PROM2
  Gene Name: prominin 2
  ENST ID: ENST00000431567
  CDS Start-End: 86-595
gggacagaggctggagaaggatgtatggcctgccctgggcttgtctgttccctcctgagcctgagccccttaccttcctgaccccatgaagcacacactggctctgctggctcccctgctgggcctgggcctggggctggccctgagtcagctggctgcaggggccacagactgcaagttccttggcccggcagagcacctgacattcaccccagcagccagggcccggtggctggcccctcgagttcgtgcgccaggactcctggactccctctatggcaccgtgcgccgcttcctctcggtggtgcagctcaatcctttcccttcagagttggtaaaggccctactgaatgagctggcctccgtgaaggtgaatgaggcagaagccagggctgggcagtgggggtcgggtcacccctcatgccctgctgcctgcccaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtcttcctgctgctgaccaccctcttgctgctgattggtgtggtctgtgcctttgtcaccaaccagcgcacgcatgaacagatgggccccagcatcgaggccatgcctgagaccctgctcagcctctggggcctggtctctgatgtcccccaagagctgcaggccgtggcacagcaattctccctgccccaggagcaagtctcagaggagctggatggtgttggtgtgagcattgggagcgcgatccacactcagctcaggagctccgtgtaccccttgctggcggccgtgggcagtttgggccaggtcctgcaggtctccgtgcaccacctgcaaaccttgaatgctacagtggtagagctgcaggccgggcagcaggacctggagccagccatccgggaacaccgggaccgcctccttgagctgctgcaggaggccaggtgccctctgtggaccatgtcctgcaccagctaaaaggtgtccccgaggccaacttctccagcatggtccaggaggagaacagcaccttcaacgcccttccagccctggctgccatgcagacatccagcgtggtgcaagagctgaagaaggcagtggcccagcagccggaaggggtgaggacactggctgaagggttcccgggcttggaggcagcttcccgctgggcccaggcactgcaggaggtggaggagagcagccgcccctacctgcaggaggtgcagagatacgagacctacaggtggatcgtgggctgcgtgctgtgctccgtggtcctattcgtggtgctctgcaacctgctgggcctcaatctgggcatctggggcctgtctgccagggacgaccccagccacccagaagccaagggcgaggctggagcccgcttcctcatggcaggtgtgggcctcagcttcctctttgctgcacccctcatcctcctggtgttcgccaccttcctggtgggtggcaacgtgcagacgctggtgtgccagagctgggagaacggcgagctctttgagtttgcagacaccccagggaacctgcccccgtccatgaacctgtcgcaacttcttggcctgaggaagaacatcagcatccaccaagcctatcagcagtgcaaggaaggggcagcgctctggacagtcctgcagctcaacgactcctacgacctggaggagcacctggatatcaaccagtataccaacaagctacggcaggagttgcagagcctgaaagtagacacacagagcctggacctgctgagctcagccgcccgccgggacctggaggccctgcagagcagtgggcttcagcgcatccactaccccgacttcctcgttcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtgggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttccctgagacttggttctgggtccttaaaaccaggtttcctaggctgggaccctgtacatagttggtgtttaatgagtgtttatggagaggagagttctaaggtcacctctggctgcaggcatccagggattattccagcaatctgcaggtagggagtgggtcccagcctgggagcctgctgtcaggagcaggcagacctggactcacagcctggctgtgatgcttgttcgctcagcttctccatttatgagatggggagaatagtcacagcctcctcaaagggttgtgaaaatcaaatgtgataatttgtggaaagcccttagcagtggcctggcacaaaacaaatgctcagtggatggaagctgcctattattattgtcgttgttgttgtttgccatgactgctctgggccgggggtagagctagcatccgggcatgtacgagggaagagggaggcaggcctctattcaaaggcagaaattcctttaagattgtggtctgctgggtttcagggagtgtctgtgttgtttgtttttgtttgtttgtttgttttgagacagggtctcgctctgtcacccaggctggagtgtagtggtgcagtcttggctcactgcaacctccacctcctgggctcaagcgattctcatgcctcagcctcccgagtagctgggactacaggtgtgtgccactatgcctggctaatttttgtattttttgtagagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaatagaaa

SEQ ID NO: 169795 - DNA, 4508 bp, Homo sapiens
  Payload ID: 13426
  Gene Symbol: PML
  Gene Name: promyelocytic leukemia
  Uniprot ID: P29590
  ENST ID: ENST00000268058
  CDS Start-End: 97-2745
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaa

SEQ ID NO: 169796 - DNA, 3029 bp, Homo sapiens
  Payload ID: 13426
  Gene Symbol: PML
  Gene Name: promyelocytic leukemia
  Uniprot ID: P29590
  ENST ID: ENST00000268059
  CDS Start-End: 97-2586
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 169797 - DNA, 2885 bp, Homo sapiens
  Payload ID: 13426
  Gene Symbol: PML
  Gene Name: promyelocytic leukemia
  Uniprot ID: P29590
  ENST ID: ENST00000354026
  CDS Start-End: 97-2442
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 169798 - DNA, 1726 bp, Homo sapiens
  Payload ID: 13426
  Gene Symbol: PML
  Gene Name: promyelocytic leukemia
  Uniprot ID: P29590
  ENST ID: ENST00000359928
  CDS Start-End: 70-1341
cgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctta

SEQ ID NO: 169799 - DNA, 1738 bp, Homo sapiens
  Payload ID: 13426
  Gene Symbol: PML
  Gene Name: promyelocytic leukemia
  Uniprot ID: P29590
  ENST ID: ENST00000395132
  CDS Start-End: 97-1404
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 169800 - DNA, 2199 bp, Homo sapiens
  Payload ID: 13426
  Gene Symbol: PML
  Gene Name: promyelocytic leukemia
  Uniprot ID: P29590
  ENST ID: ENST00000395135
  CDS Start-End: 141-2042
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctt

SEQ ID NO: 169801 - DNA, 3010 bp, Homo sapiens
  Payload ID: 13426
  Gene Symbol: PML
  Gene Name: promyelocytic leukemia
  Uniprot ID: P29590
  ENST ID: ENST00000436891
  CDS Start-End: 70-1752
cgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 169802 - DNA, 3643 bp, Homo sapiens
  Payload ID: 13426
  Gene Symbol: PML
  Gene Name: promyelocytic leukemia
  Uniprot ID: P29590
  ENST ID: ENST00000435786
  CDS Start-End: 70-1905
cgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 169803 - DNA, 2251 bp, Homo sapiens
  Payload ID: 13426
  Gene Symbol: PML
  Gene Name: promyelocytic leukemia
  Uniprot ID: P29590
  ENST ID: ENST00000569477
  CDS Start-End: 83-2008
gccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccagga

SEQ ID NO: 169804 - DNA, 5393 bp, Homo sapiens
  Payload ID: 13426
  Gene Symbol: PML
  Gene Name: promyelocytic leukemia
  Uniprot ID: P29590
  ENST ID: ENST00000565898
  CDS Start-End: 85-2589
cagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaagcctgatgctccaatcacagactctgctcagcatccccagaggaaccactgagaagccttttgcctggataggagggggctctcccaggcataggcttgtggccacttgcccagcacaactgtgttttgtggggcgtcttttaggacttagcagagctgagagccctttgttgctcaatgctgtgagccttaagcatgtgaatccccccacatgacaagtggggagacccagggtaggctttcctttggatcatctccaaatgggagtgccatgtggcaggaaagaagcaccgatttcaagaattacttcctagagaaagtcaggaactagagaccagagtctgcaggaactttgccactgcccttcactggctaatcctgtacttctctctgtgttccttgagtgacaggtggtaaaacccttaaaaagggaggtgtgggaggcccaggactttggtaacaggtgatgaatgtgttgtcttggccatcacaggtggagcttcagttagtacccgagggattcccctggcacaagcattataggaattagtccaccactggcgtgggtgagcagccaggtaatgggaattgatcagtgccaccacccttgaccccaactaccatcccagatgcccagattccagtcctggagttttattctctcagcttgatcctttgaccaagaagatccagtcccaatatgtcacctgtgcttcatctttggactatatctcaggtgtttacgtgtcaactaatgggagcttactgggttagaagtcaggacactgagtttcaatcctcacttagtagtctgtggccctctttggcacattaacctccctccttgatcctcaggctgcacctctggcaaatgggagaatgcggctccttttgacttcaagggatctttgtgggaaccaatgagaaaatgtgtgtgaagatagctttttggtatattttaaaagtgcacaaatttaagatcttactgctttataaagtgctttatgaattataggaaaataaacacattttagatcttag

SEQ ID NO: 169805 - DNA, 1404 bp, Homo sapiens
  Payload ID: 13426
  Gene Symbol: PML
  Gene Name: promyelocytic leukemia
  Uniprot ID: P29590
  ENST ID: ENST00000567543
  CDS Start-End: 70-1341
cgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgaggaacgcgttgtggtgatcagcagctcggaagactcagatgccgaaaactcggtgagtggcccagaagttcagcccagga

SEQ ID NO: 169806 - DNA, 2232 bp, Homo sapiens
  Payload ID: 13426
  Gene Symbol: PML
  Gene Name: promyelocytic leukemia
  ENST ID: ENST00000562086
  CDS Start-End: 1-333
agcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 169807 - DNA, 2148 bp, Homo sapiens
  Payload ID: 13426
  Gene Symbol: PML
  Gene Name: promyelocytic leukemia
  Uniprot ID: P29590
  ENST ID: ENST00000569965
  CDS Start-End: 81-1763
caactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctta

SEQ ID NO: 169808 - DNA, 783 bp, Homo sapiens
  Payload ID: 13426
  Gene Symbol: PML
  Gene Name: promyelocytic leukemia
  ENST ID: ENST00000565239
  CDS Start-End: 1-721
cagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggccctgcacagagtagcactcattaattcttggttaaggaatgaatcaacgaatgaatggctatgcatggacctctgggcagggagac

SEQ ID NO: 169809 - DNA, 1985 bp, Homo sapiens
  Payload ID: 13426
  Gene Symbol: PML
  Gene Name: promyelocytic leukemia
  Uniprot ID: P29590
  ENST ID: ENST00000564428
  CDS Start-End: 70-1827
cgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctta

SEQ ID NO: 169810 - DNA, 4502 bp, Homo sapiens
  Payload ID: 13426
  Gene Symbol: PML
  Gene Name: promyelocytic leukemia
  ENST ID: ENST00000563500
  CDS Start-End: 11-1717
gctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaattctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccgtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatc

SEQ ID NO: 169811 - DNA, 2042 bp, Homo sapiens
  Payload ID: 13426
  Gene Symbol: PML
  Gene Name: promyelocytic leukemia
  ENST ID: ENST00000567606
  CDS Start-End: 1-784
tgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 169812 - DNA, 834 bp, Homo sapiens
  Payload ID: 13426
  Gene Symbol: PML
  Gene Name: promyelocytic leukemia
  ENST ID: ENST00000566068
  CDS Start-End: 1-653
gccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctcccca

SEQ ID NO: 169813 - DNA, 1074 bp, Homo sapiens
  Payload ID: 13427
  Gene Symbol: POMC
  Gene Name: proopiomelanocortin
  Uniprot ID: P01189
  ENST ID: ENST00000264708
  CDS Start-End: 175-978
ggaggggaagaagagccgcgaccgagagaggccgccgagcgtccccgccctcagagagcagcctcccgagacaggcacttgctggattctccaaaagtatctgcagtggctgttccaccaggaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctgggggg

SEQ ID NO: 169814 - DNA, 1295 bp, Homo sapiens
  Payload ID: 13427
  Gene Symbol: POMC
  Gene Name: proopiomelanocortin
  Uniprot ID: P01189
  ENST ID: ENST00000380794
  CDS Start-End: 264-1067
ccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagc

SEQ ID NO: 169815 - DNA, 959 bp, Homo sapiens
  Payload ID: 13427
  Gene Symbol: POMC
  Gene Name: proopiomelanocortin
  Uniprot ID: P01189
  ENST ID: ENST00000395826
  CDS Start-End: 128-931
ggacagaggagcgcgggaccaagcggcggcgaaggaggggaagaagagccgcgaccgagagaggccgccgagcgtccccgccctcagagagcagcctcccgagacagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccct

SEQ ID NO: 169816 - DNA, 1426 bp, Homo sapiens
  Payload ID: 13427
  Gene Symbol: POMC
  Gene Name: proopiomelanocortin
  Uniprot ID: P01189
  ENST ID: ENST00000405623
  CDS Start-End: 457-1260
acctcagaggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatcca

SEQ ID NO: 169817 - DNA, 883 bp, Homo sapiens
  Payload ID: 13427
  Gene Symbol: POMC
  Gene Name: proopiomelanocortin
  ENST ID: ENST00000449220
  CDS Start-End: 145-883
ggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagcc

SEQ ID NO: 169818 - DNA, 1464 bp, Homo sapiens
  Payload ID: 13428
  Gene Symbol: PROP1
  Gene Name: PROP paired-like homeobox 1
  Uniprot ID: O75360
  ENST ID: ENST00000308304
  CDS Start-End: 310-990
gcatcccggtggggagaagggccaggcagagaaaagtagtcagaaacagagcaacaggtgaggctgaggcaggagattgagctgacactcaagccaaggaagggggaattaggaaacaattagaaaaaaagtaaagacagtgaaaaagtcagagacagctgcctgcacctacacacacattcagagacagagtcccagagggtggcatacacagagggagaaggggagggaacaggtgtggagaggagctgcggaagcagagaaatctcaagtcagagattcagggacacttggtccccgtggcgagccatggaagcagaaaggaggcgccaggctgagaagccaaagaaggggcgagtcggcagcaacctgttgcctgagagacacccggccactgggaccccgaccaccacggtggactcgagtgctccaccctgcagaaggctccctggtgcaggaggggggagatcaaggttctccccgcaaggaggacagaggggccgcccgcactcccggcgccgccaccgcaccaccttcagcccagtgcagttggaacagctggagtcagcctttgggaggaaccagtaccccgacatctgggcccgagagagtcttgcccgggacactggcctcagtgaggcccgaatccaggtctggttccagaaccgcagagctaagcaacggaagcaagagcgctcactgcttcagcctctggcccatctgtctcctgccgccttttccagcttcttgccagagtccactgcttgcccctattcttacgcagcaccaccaccaccagtgacctgcttccctcacccctacagccatgccctcccttcccagccctccacaggaggcgcctttgctttgtcacaccagtctgaggactggtaccctaccttgcacccagcccctgccggccatctgccctgccccccaccccctcccatgctccccctcagccttgagccatccaagtcctggaactgaggtcaaacaagtaccaccaaggtgatccccagcctgcggccctcgtgaaaagacaagaaaatggggtggcttcctttccatctatgggtgaagcagatgcatggtgagggtcagctcagcgattagaaatttaaaaatgggagatcatggtgaattctcactggggtgattagtggaggaagtctggggaggtgagctactggaagagacagggcaagatgcctcggtggagctgcctgctgaagggtgatattgatgaagacagttgctggtgagtggagatgattgaagggctaggaggtgagggccttcattaattgagatcacgattgaagaagatcccagctctttctggctgatttcagtaaggcttctgacttaagagtctacctatacatcccttccccattgcccaccccgccatctcaatcagtcactgacttttgtttattctgtcctagaaatacctttttt

SEQ ID NO: 169819 - DNA, 1333 bp, Homo sapiens
  Payload ID: 13428
  Gene Symbol: PROP1
  Gene Name: PROP paired-like homeobox 1
  ENST ID: ENST00000614006
  CDS Start-End: 179-859
taaagacagtgaaaaagtcagagacagctgcctgcacctacacacacattcagagacagagtcccagagggtggcatacacagagggagaaggggagggaacaggtgtggagaggagctgcggaagcagagaaatctcaagtcagagattcagggacacttggtccccgtggcgagccatggaagcagaaaggaggcgccaggccgagaagccaaagaaggggcgagtcggcagcagcctgttgcctgagagacacccggccactgggaccccgaccaccacggtggactcgagtgctccaccctgcagaaggctccctggtgcaggaggggggagatcaaggttctccccgcaaggaggacagaggggccgcccgcactcccggcgccgccaccgcaccaccttcagcccagtgcagttggaacagctggagtcagcctttgggaggaaccagtaccccgacatctgggcccgagagagtcttgcccgggacactggcctcagtgaggcccgaatccaggtctggttccagaaccgcagagctaagcaacggaagcaagagcgctcactgcttcagcctctggcccatctgtctcctgccgccttttccagcttcttgccagagtccactgcttgcccctattcttacgcagcaccaccaccaccagtgacctgcttccctcacccctacagccatgccctcccttcccagccctccacaggaggcgcctttgctttgtcacaccagtctgaggactggtaccctaccttgcacccagcccctgccggccatctgccctgccccccaccccctcccatgctccccctcagccttgagccatccaagtcctggaactgaggtcaaacaagtaccaccaaggtgatccccagcctgcggccctcgtgaaaagacaagaaaatggggtggcttcctttccatctatgggtgaagcagatgcatggtgagggtcagctcagtgattagaaatttaaaaatgggagatcatggtgaattctcactggggtgattagtggaggaagtctggggaggtgagctactggaagagacagggcaagatgcctcggtggagctgcctgctgaagggtgatattgatgaagacagttgctggtgagtggagatgattgaagggctaggaggtgagggccttcattaattgagatcacgattgaagaagatcccagctctttctggctgatttcagtaaggcttctgacttaagagtctacctatacatcccttccccattgcccaccccgccatctcaatcagtcactgacttttgtttattctgtcctagaaatacctttttt

SEQ ID NO: 169820 - DNA, 813 bp, Homo sapiens
  Payload ID: 13428
  Gene Symbol: PROP1
  Gene Name: PROP paired-like homeobox 1
  ENST ID: ENST00000629850
  CDS Start-End: 1-339
gtctggttccagaaccgcagagctaagcaacggaagcaagagcgctcactgcttcagcctctggcccatctgtctcctgccgccttttccagcttcttgccagagtccactgcttgcccctattcttacgcagcaccaccaccaccagtgacctgcttccctcacccctacagccatgccctcccttcccagccctccacaggaggcgcctttgctttgtcacaccagtctgaggactggtaccctaccttgcacccagcccctgccggccatctgccctgccccccaccccctcccatgctccccctcagccttgagccatccaagtcctggaactgaggtcaaacaagtaccaccaaggtgatccccagcctgcggccctcgtgaaaagacaagaaaatggggtggcttcctttccatctatgggtgaagcagatgcatggtgagggtcagctcagcgattagaaatttaaaaatgggagatcatggtgaattctcactggggtgattagtggaggaagtctggggaggtgagctactggaagagacagggcaagatgcctcggtggagctgcctgctgaagggtgatattgatgaagacagttgctggtgagtggagatgattgaagggctaggaggtgagggccttcattaattgagatcacgattgaagaagatcccagctctttctggctgatttcagtaaggcttctgacttaagagtctacctatacatcccttccccattgcccaccccgccatctcaatcagtcactgacttttgtttattctgtcctagaaatacctttttt

SEQ ID NO: 169821 - DNA, 2418 bp, Homo sapiens
  Payload ID: 13429
  Gene Symbol: PCCA
  Gene Name: propionyl CoA carboxylase, alpha polypeptide
  Uniprot ID: P05165
  ENST ID: ENST00000376279
  CDS Start-End: 107-2152
ggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 169822 - DNA, 2494 bp, Homo sapiens
  Payload ID: 13429
  Gene Symbol: PCCA
  Gene Name: propionyl CoA carboxylase, alpha polypeptide
  Uniprot ID: P05165
  ENST ID: ENST00000376285
  CDS Start-End: 39-2225
gtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtctaaa

SEQ ID NO: 169823 - DNA, 2481 bp, Homo sapiens
  Payload ID: 13429
  Gene Symbol: PCCA
  Gene Name: propionyl CoA carboxylase, alpha polypeptide
  Uniprot ID: P05165
  ENST ID: ENST00000376286
  CDS Start-End: 107-2215
ggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 169824 - DNA, 669 bp, Homo sapiens
  Payload ID: 13429
  Gene Symbol: PCCA
  Gene Name: propionyl CoA carboxylase, alpha polypeptide
  ENST ID: ENST00000458283
  CDS Start-End: 1-403
aatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 169825 - DNA, 447 bp, Homo sapiens
  Payload ID: 13429
  Gene Symbol: PCCA
  Gene Name: propionyl CoA carboxylase, alpha polypeptide
  ENST ID: ENST00000424527
  CDS Start-End: 1-447
ggaggaatctacttttaccatggaaggaaaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccag

SEQ ID NO: 169826 - DNA, 602 bp, Homo sapiens
  Payload ID: 13429
  Gene Symbol: PCCA
  Gene Name: propionyl CoA carboxylase, alpha polypeptide
  ENST ID: ENST00000428969
  CDS Start-End: 1-336
tacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggcaacctcgagtctgtctgtagagatctgcctattctggacatttcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtct

SEQ ID NO: 169827 - DNA, 418 bp, Homo sapiens
  Payload ID: 13429
  Gene Symbol: PCCA
  Gene Name: propionyl CoA carboxylase, alpha polypeptide
  ENST ID: ENST00000443601
  CDS Start-End: 1-418
agaacatcagtttatgtcctgaaatatgttttcagaaaatagaaagccaagtatatttcgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaag

SEQ ID NO: 169828 - DNA, 397 bp, Homo sapiens
  Payload ID: 13429
  Gene Symbol: PCCA
  Gene Name: propionyl CoA carboxylase, alpha polypeptide
  ENST ID: ENST00000413170
  CDS Start-End: 1-253
caactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtc

SEQ ID NO: 169829 - DNA, 1833 bp, Homo sapiens
  Payload ID: 13430
  Gene Symbol: PCCB
  Gene Name: propionyl CoA carboxylase, beta polypeptide
  Uniprot ID: P05166
  ENST ID: ENST00000251654
  CDS Start-End: 71-1690
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169830 - DNA, 1436 bp, Homo sapiens
  Payload ID: 13430
  Gene Symbol: PCCB
  Gene Name: propionyl CoA carboxylase, beta polypeptide
  ENST ID: ENST00000482086
  CDS Start-End: 22-1293
ggacgcgccggcacagcaaaaatggcggcggcattacgggtggcggcggtcggggcaaggctcagcgttctggcgagcggtctccgcgccgcggtccgcagcctttgcagccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169831 - DNA, 6090 bp, Homo sapiens
  Payload ID: 13430
  Gene Symbol: PCCB
  Gene Name: propionyl CoA carboxylase, beta polypeptide
  ENST ID: ENST00000471595
  CDS Start-End: 19-1671
cgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtaagagtccaagaagtgtttcaccaggttgtgcagtctggacaccgagatggtagaggggctgtaagatggtagaggaaccagctcaggagagcagctgggctagcagctttacggaagccttggatggtggggaaactcccgtacagaaactcagctggtcaaagaaactcaaagccacaagaccttggaagctttgtcaagtggaccagcctccatggaccacggaataccttgagagtaatgacagttgagtgttctcttgtgtgggaatgccttccccagctggtgccctcaccttaaagggaaaaagaaaatacactgaattttgtaaatgggaaatacttgggtccactgagctgatagctgacaagtgtctgtctttaaactgagagcagataatatggtgagctgtggtgtaggaagcactgctagggtcttgctggtcctgccccgccttgtgttaatccagttcctcctgagctacacagctgacaagtggtgaagctgggatttgaactcagatgggtttgaccccagccaagcctgtgttctgatcatttcaaagtactaccactcagctgatgaggaaggtgagatggacttctaagggttggcctaagagtaggggtgagggaggttggtggtctgttcccctgggcttgtcttaacccagaaagctactacatttagacagctttcctatctcccgcatgattctcttgcaaagcagtaccaacagatggccagtcatctttttgagttgctagagtaatggggagcacatccacaatacacccttctaatgcttgttagaaagtgcttttgttgcaaagttcttctagcttctttttttgaccctgtcttggtctccccagcccaactttctgcctctggttgcactgatactttgtcctggtgctggtgcttaagatgtggtctgctcagccaaagaagtctgtgaaggatactcacccacatgtggagttgatgaatcagccctcttcacctattcaacagatgtgactgttttgtctttctggttccaaaggatttctggagagctatgactttacccttttagaagtattggtcctcatactctgtgcacctctgatgtcagcatgggatttctacaattccaagcaggagttgcagccacttgataggcagtgcctcagtctggggcctctgtggaatccagctggcatattccagccaatgtggcagcctcaatagttagttaagttttgaccatgtccctactgtcctgggtggtgaaaatactccctttatgtgtccttgggagcagaaagatgctcttcaaaaagtggtgcctgatggagatctccacagaacaagacactcagaagggcagggatagaatcttacctgagcttggtctagtatgaaaagcctaaggctgggtgcgatggcccatgccctgtaatcccagcactttgggaggccaaggcaggtggattgcttgagctcagttcatgaccggcctgggcaacatggtgaaagcctgtctctactaaaaatacaaaacttagctgggcgtggtggtgggtgcctgtaattccagctacttgagagcctgaggcaggagaatctcttgaaccccagaggcggaggttgctgtgagctgagatcacaccattgtactccagcctgggtgacagaccgagaccctgtcttcacttaccgccccccccccccccccgaaaaaaaaaaggcaagcctgagtggcatcaaacctttgtttcccatgaatatactagtccctgcttgatggactgttacctgggaacaggggcaaacagggagttacagtcaagccacaaatgggagatttgcaagcctgacccaagcctgaaagtgctcatctagtctcatactcttgtaaccatctagatgagctgttacagaccatccttaaatgaccttccttccttggctgtctggaaagcttgcttgctgatttgtctcccacacctttgccttttttgcataggcatattaggccatttaaggaactcaccccctattgccagacccatgaagtgtgtagggtatgacttcttaaagaaagagtgaggaggtctaatgccaagagaaactttttaagacagtctggctctgttacctagattggagtgcagtagtggtgcaatcttggctcactgcaacaacctccaccttgtgggctcaagccatcctcctaccttagcctcacgagtagctggtgtgcgccatcatacgcagctaatttttgtattttttgtagaggagttttaccatgctacccaggctggtctcgaactcttgagctcaagtgatccactcaccttggccttccaaagtgctgggattacaggcgtgagccaccatgcctggctgaaaacttcatttctgtagctgcattgactctatgtggtcttcaaaagggcactgccagggtgcaattatgcatgtaagcccagagtctcaagccgtgaggacccatgctacaggccagtggatgggtgttccctgaatgcctcatgcaaaactcagtttgcaagagactccctcttaaaccacagatgacttggcctacacacactccagagaaatctaaggaatgaaagaaagtgagctattcctaaattctgctttcttaaaaaaaattaaaaagccaaaacaacaaaaccaccaactcactaataaggttaacttgctgccatttaacagattatcagaaattgcaaactctctcaagagccacaggacagaaaatcatctctttaaagccatacctggtagaaacaataggatgactaccacaagcctgattttgaatagtttattaaaggaaaggtgaagcatcagtttcaaattgtacaaaaggaaaaaaaacctcatattgcaaatgtacaatttacagaattactagcaaaaccaatcaaggagacaccgaaaatacaaaaatttgattgacttcaaactgaactggaaacccattggagtagatatttagcctttttgtgtggcatggtagtctacaattctgtcagcatctgttttccatacaagactgtcacgcaaaggatcaatttgtgcatgtgccagggcacctcatggcttgctccctggccaaaaccacaggcaggcagggctggggtggacagtccagtcattcctgcaccttcacttccagtgaagcccacaattctgggagaaagtgaggccccagctcccctaactggagcccaagaattgctgaattagcagagaagatatttttggtgaccaggtttttttcagaactgtacaaatgttgagaaaaatgttttgtgtctttactaaaaggatgaataaaatcatccatcatcatcttgctttcccgcacaaaagatgatcactgggtgtgcagaattttaaaaaatgtttttcgtatttgataaaaagggaaagcctcatgattctgttgcagctactttaaaaaccagcccagaaacagctgtggatgaattggtttggaaattctgaggcttactttagaaatcagaaaggaagagagagactaagtggggtttttaaaacaatagcagcaagtcataaaagtctaggcagaatgtaactctaaaccattgtagactgtcctgaagattcataatttctttccccaaaagaattattcttaatatgcacatttaacactgaaatgtagctgtaattcaaggtaagcttaggaacttcaccctctaagcacagacttctatgcagcacatacttctataatcagtaaacttaattcacaaaattagcgcataagggtattaagtgcatgggaagtaaacacagttatgttacacttaaaattacttttgaatgattgataaaggatttcttcatgattgattatcttaagaaaatggaagtctgtgtaacttgaatttggcagggcatgaaataagtggtaaaaacagcaaactgataacttgagaatcattttcgttttactgagaatactttatttgctggtagaagttgctaaaaatgcacagaacaaataccaatagaaaatgcactgtatttgaatctccctagtctatataaaatgaacggtgtacagcatctgttggaaaaatggctgcatggacatttcttattttatgcccacttataaataaaaataaaccttttattcaagagtatataaaatctgggaattcatatccatatccacagagggtgtgtggtttttggcagagatgtactatgtcagaatttcatcttagcttgtcaatgttctgctccttcattatttgtgttccacaaaggtcaaccaaatccagtgaactccaaaacactcttcgcaattaggatgagctgcttactcataggtttaataaaaatggttagcttttaaaacataaaaaggcaaaatgttaaaacggtttttaaattgtacaacaggaaaataaagttaaaaatatgttttttttt

SEQ ID NO: 169832 - DNA, 1683 bp, Homo sapiens
  Payload ID: 13430
  Gene Symbol: PCCB
  Gene Name: propionyl CoA carboxylase, beta polypeptide
  ENST ID: ENST00000484181
  CDS Start-End: 22-1239
ggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169833 - DNA, 547 bp, Homo sapiens
  Payload ID: 13430
  Gene Symbol: PCCB
  Gene Name: propionyl CoA carboxylase, beta polypeptide
  ENST ID: ENST00000494742
  CDS Start-End: 294-547
acaggggataggatagtaggagaaggagaagcccacagaggaggcaggagaagaaccaggaagtagcgtgtccttgaggtgggagctgggagcagtagggaccctcgtgaggtgaggtgtgcttctgtaggtctccctagaaaaaacctgtgtcagatccttcactaagcctgctttagtttccaccacctgcttctgcattctttttatggctccttaggtctccaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaaga

SEQ ID NO: 169834 - DNA, 1613 bp, Homo sapiens
  Payload ID: 13430
  Gene Symbol: PCCB
  Gene Name: propionyl CoA carboxylase, beta polypeptide
  ENST ID: ENST00000490504
  CDS Start-End: 22-1470
ggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcagaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169835 - DNA, 1841 bp, Homo sapiens
  Payload ID: 13430
  Gene Symbol: PCCB
  Gene Name: propionyl CoA carboxylase, beta polypeptide
  Uniprot ID: P05166
  ENST ID: ENST00000469217
  CDS Start-End: 18-1697
gcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcagcaaataataggctgggcacagtggctcccgcttgtcatctcagcactttgggaggccgaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatct

SEQ ID NO: 169836 - DNA, 1877 bp, Homo sapiens
  Payload ID: 13430
  Gene Symbol: PCCB
  Gene Name: propionyl CoA carboxylase, beta polypeptide
  ENST ID: ENST00000468777
  CDS Start-End: 22-1734
ggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcagatacgggcttctgccatgtcgcccaggctggtctcagactcctggactcaagccatccacctgccttggcctcccaaagtgttgggattacaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169837 - DNA, 582 bp, Homo sapiens
  Payload ID: 13430
  Gene Symbol: PCCB
  Gene Name: propionyl CoA carboxylase, beta polypeptide
  ENST ID: ENST00000465423
  CDS Start-End: 8-582
agcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgagctagagtgcagcagctcactgcaacttctgcttcccagcttcaagcaattctcctgcctcagcctccagagtacctggggttacagggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctggggg

SEQ ID NO: 169838 - DNA, 534 bp, Homo sapiens
  Payload ID: 13430
  Gene Symbol: PCCB
  Gene Name: propionyl CoA carboxylase, beta polypeptide
  ENST ID: ENST00000459873
  CDS Start-End: 134-534
gatagtaggagaaggagaagcccacagaggaggcaggagaagaaccaggaagtagcgtgtccttgagggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggt

SEQ ID NO: 169839 - DNA, 488 bp, Homo sapiens
  Payload ID: 13430
  Gene Symbol: PCCB
  Gene Name: propionyl CoA carboxylase, beta polypeptide
  ENST ID: ENST00000462542
  CDS Start-End: 1-488
gagaatccagctggccttcagagataagctgggcggcccattttggagagggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactcc

SEQ ID NO: 169840 - DNA, 1844 bp, Homo sapiens
  Payload ID: 13430
  Gene Symbol: PCCB
  Gene Name: propionyl CoA carboxylase, beta polypeptide
  ENST ID: ENST00000466072
  CDS Start-End: 22-1701
ggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcagattccatttcctttactccttggaactatgctaggaggcagtatcgtccctactttgcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169841 - DNA, 1715 bp, Homo sapiens
  Payload ID: 13430
  Gene Symbol: PCCB
  Gene Name: propionyl CoA carboxylase, beta polypeptide
  ENST ID: ENST00000462637
  CDS Start-End: 22-1572
ggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169842 - DNA, 1727 bp, Homo sapiens
  Payload ID: 13430
  Gene Symbol: PCCB
  Gene Name: propionyl CoA carboxylase, beta polypeptide
  ENST ID: ENST00000483687
  CDS Start-End: 22-1584
ggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcagatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatc

SEQ ID NO: 169843 - DNA, 4502 bp, Homo sapiens
  Payload ID: 13430
  Gene Symbol: PCCB
  Gene Name: propionyl CoA carboxylase, beta polypeptide
  ENST ID: ENST00000478469
  CDS Start-End: 2-913
aatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagcccaactttctgcctctggttgcactgatactttgtcctggtgctggtgcttaagatgtggtctgctcagccaaagaagtctgtgaaggatactcacccacatgtggagttgatgaatcagccctcttcacctattcaacagatgtgactgttttgtctttctggttccaaaggatttctggagagctatgactttacccttttagaagtattggtcctcatactctgtgcacctctgatgtcagcatgggatttctacaattccaagcaggagttgcagccacttgataggcagtgcctcagtctggggcctctgtggaatccagctggcatattccagccaatgtggcagcctcaatagttagttaagttttgaccatgtccctactgtcctgggtggtgaaaatactccctttatgtgtccttgggagcagaaagatgctcttcaaaaagtggtgcctgatggagatctccacagaacaagacactcagaagggcagggatagaatcttacctgagcttggtctagtatgaaaagcctaaggctgggtgcgatggcccatgccctgtaatcccagcactttgggaggccaaggcaggtggattgcttgagctcagttcatgaccggcctgggcaacatggtgaaagcctgtctctactaaaaatacaaaacttagctgggcgtggtggtgggtgcctgtaattccagctacttgagagcctgaggcaggagaatctcttgaaccccagaggcggaggttgctgtgagctgagatcacaccattgtactccagcctgggtgacagaccgagaccctgtcttcacttaccgccccccccccccccccgaaaaaaaaaaggcaagcctgagtggcatcaaacctttgtttcccatgaatatactagtccctgcttgatggactgttacctgggaacaggggcaaacagggagttacagtcaagccacaaatgggagatttgcaagcctgacccaagcctgaaagtgctcatctagtctcatactcttgtaaccatctagatgagctgttacagaccatccttaaatgaccttccttccttggctgtctggaaagcttgcttgctgatttgtctcccacacctttgccttttttgcataggcatattaggccatttaaggaactcaccccctattgccagacccatgaagtgtgtagggtatgacttcttaaagaaagagtgaggaggtctaatgccaagagaaactttttaagacagtctggctctgttacctagattggagtgcagtagtggtgcaatcttggctcactgcaacaacctccaccttgtgggctcaagccatcctcctaccttagcctcacgagtagctggtgtgcgccatcatacgcagctaatttttgtattttttgtagaggagttttaccatgctacccaggctggtctcgaactcttgagctcaagtgatccactcaccttggccttccaaagtgctgggattacaggcgtgagccaccatgcctggctgaaaacttcatttctgtagctgcattgactctatgtggtcttcaaaagggcactgccagggtgcaattatgcatgtaagcccagagtctcaagccgtgaggacccatgctacaggccagtggatgggtgttccctgaatgcctcatgcaaaactcagtttgcaagagactccctcttaaaccacagatgacttggcctacacacactccagagaaatctaaggaatgaaagaaagtgagctattcctaaattctgctttcttaaaaaaaattaaaaagccaaaacaacaaaaccaccaactcactaataaggttaacttgctgccatttaacagattatcagaaattgcaaactctctcaagagccacaggacagaaaatcatctctttaaagccatacctggtagaaacaataggatgactaccacaagcctgattttgaatagtttattaaaggaaaggtgaagcatcagtttcaaattgtacaaaaggaaaaaaaacctcatattgcaaatgtacaatttacagaattactagcaaaaccaatcaaggagacaccgaaaatacaaaaatttgattgacttcaaactgaactggaaacccattggagtagatatttagcctttttgtgtggcatggtagtctacaattctgtcagcatctgttttccatacaagactgtcacgcaaaggatcaatttgtgcatgtgccagggcacctcatggcttgctccctggccaaaaccacaggcaggcagggctggggtggacagtccagtcattcctgcaccttcacttccagtgaagcccacaattctgggagaaagtgaggccccagctcccctaactggagcccaagaattgctgaattagcagagaagatatttttggtgaccaggtttttttcagaactgtacaaatgttgagaaaaatgttttgtgtctttactaaaaggatgaataaaatcatccatcatcatcttgctttcccgcacaaaagatgatcactgggtgtgcagaattttaaaaaatgtttttcgtatttgataaaaagggaaagcctcatgattctgttgcagctactttaaaaaccagcccagaaacagctgtggatgaattggtttggaaattctgaggcttactttagaaatcagaaaggaagagagagactaagtggggtttttaaaacaatagcagcaagtcataaaagtctaggcagaatgtaactctaaaccattgtagactgtcctgaagattcataatttctttccccaaaagaattattcttaatatgcacatttaacactgaaatgtagctgtaattcaaggtaagcttaggaacttcaccctctaagcacagacttctatgcagcacatacttctataatcagtaaacttaattcacaaaattagcgcataagggtattaagtgcatgggaagtaaacacagttatgttacacttaaaattacttttgaatgattgataaaggatttcttcatgattgattatcttaagaaaatggaagtctgtgtaacttgaatttggcagggcatgaaataagtggtaaaaacagcaaactgataacttgagaatcattttcgttttactgagaatactttatttgctggtagaagttgctaaaaatgcacagaacaaataccaatagaaaatgcactgtatttgaatctccctagtctatataaaatgaacggtgtacagcatctgttggaaaaatggctgcatggacatttcttattttatgcccacttataaataaaaataaaccttttattcaagagtatataaaatctgggaattcatatccatatccacagagggtgtgtggtttttggcagagatgtactatgtcagaatttcatcttagcttgtcaatgttctgctccttcattatttgtgttccacaaaggtcaaccaaatccagtgaactccaaaacactcttcgcaattaggatgagctgcttactcataggtttaataaaaatggttagcttttaaaacataaaaaggcaaaatgttaaaacggtttttaaattgtacaacaggaaaataaagttaaaaatatgttttttttta

SEQ ID NO: 169844 - DNA, 715 bp, Homo sapiens
  Payload ID: 13431
  Gene Symbol: PPBP
  Gene Name: pro-platelet basic protein (chemokine (C-X-C motif) ligand 7)
  Uniprot ID: P02775
  ENST ID: ENST00000296028
  CDS Start-End: 95-481
agaagccacttatctgcagacttgtaggcagcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctggaattcatcccaaaaacatccaaagtttggaagtgatcgggaaaggaacccattgcaaccaagtcgaagtgatagccacactgaaggatgggaggaaaatctgcctggacccagatgctcccagaatcaagaaaattgtacagaaaaaattggcaggtgatgaatctgctgattaatttgttctgtttctgccaaacttctttaactcccaggaagggtagaattttgaaaccttgattttctagagttctcatttattcaggatacctattcttactgtattaaaatttggatatgtgtttcattctgtctcaaaaatcacattttattctgagaaggttggttaaaagatggcagaaagaagatgaaaataaataagcctggtttcaaccctctaattcttgcctaaa

SEQ ID NO: 169845 - DNA, 5086 bp, Homo sapiens
  Payload ID: 13432
  Gene Symbol: PCSK1
  Gene Name: proprotein convertase subtilisin/kexin type 1
  Uniprot ID: P29120
  ENST ID: ENST00000311106
  CDS Start-End: 239-2500
tttccattctggctgggaagggctggggctccactcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaat

SEQ ID NO: 169846 - DNA, 2234 bp, Homo sapiens
  Payload ID: 13432
  Gene Symbol: PCSK1
  Gene Name: proprotein convertase subtilisin/kexin type 1
  Uniprot ID: P29120
  ENST ID: ENST00000508626
  CDS Start-End: 40-2160
cggccagtcccactgcagggtcgagatgccgaactgactatggggaagggatctatttctttcttgttcttcagccaaattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtg

SEQ ID NO: 169847 - DNA, 565 bp, Homo sapiens
  Payload ID: 13432
  Gene Symbol: PCSK1
  Gene Name: proprotein convertase subtilisin/kexin type 1
  ENST ID: ENST00000509190
  CDS Start-End: 93-565
ttttatgggaaagtaatggcacagctccagctcagcaccaaagtgaagagctctactgaggcacaatggaaagtcgagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacggg

SEQ ID NO: 169848 - DNA, 1050 bp, Homo sapiens
  Payload ID: 13433
  Gene Symbol: PCSK1N
  Gene Name: proprotein convertase subtilisin/kexin type 1 inhibitor
  Uniprot ID: Q9UHG2
  ENST ID: ENST00000218230
  CDS Start-End: 102-884
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctagcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 169849 - DNA, 4740 bp, Homo sapiens
  Payload ID: 13434
  Gene Symbol: PCSK2
  Gene Name: proprotein convertase subtilisin/kexin type 2
  Uniprot ID: P16519
  ENST ID: ENST00000262545
  CDS Start-End: 316-2232
gaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaa

SEQ ID NO: 169850 - DNA, 4674 bp, Homo sapiens
  Payload ID: 13434
  Gene Symbol: PCSK2
  Gene Name: proprotein convertase subtilisin/kexin type 2
  Uniprot ID: P16519
  ENST ID: ENST00000377899
  CDS Start-End: 307-2166
aactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctacaaaaaacaagggctcgtccttgcactctcgccccccatggatcacccctagaagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaa

SEQ ID NO: 169851 - DNA, 2275 bp, Homo sapiens
  Payload ID: 13434
  Gene Symbol: PCSK2
  Gene Name: proprotein convertase subtilisin/kexin type 2
  Uniprot ID: P16519
  ENST ID: ENST00000536609
  CDS Start-End: 251-2062
acacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatc

SEQ ID NO: 169852 - DNA, 2661 bp, Homo sapiens
  Payload ID: 13435
  Gene Symbol: PCSK4
  Gene Name: proprotein convertase subtilisin/kexin type 4
  Uniprot ID: Q6UW60
  ENST ID: ENST00000300954
  CDS Start-End: 63-2330
cccactcggcggtttggcgggagggaggggatttgcgcaggccccgctcccgccccgcctccatgcggcccgccccgattgcgctgtggctgcgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccgatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcacgggacccgctgtgctggggaggtggccgcgatggccaacaatggcttctgtggtgtgggggtcgctttcaacgcccgaatcggaggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcgggagtgggctggggggagaggctggagcaccccaaaagccaggggaaagtggagggagagaaacgtgacactgtccgcctcgggcaccgcgtccaacctcagagtttgcaaataaaggttgcttagaaggtg

SEQ ID NO: 169853 - DNA, 2358 bp, Homo sapiens
  Payload ID: 13435
  Gene Symbol: PCSK4
  Gene Name: proprotein convertase subtilisin/kexin type 4
  ENST ID: ENST00000591201
  CDS Start-End: 1-955
cccgattgcgctgtggctgcgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccgatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccagcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcgggagtgggctggggggagaggctggagcaccccaaaagccaggggaaagtggagggagagaaacgtgacactgtccgcctcgggcaccgcgtccaacctcagagtttgcaaataaaggttgcttagaaggtg

SEQ ID NO: 169854 - DNA, 720 bp, Homo sapiens
  Payload ID: 13435
  Gene Symbol: PCSK4
  Gene Name: proprotein convertase subtilisin/kexin type 4
  ENST ID: ENST00000588671
  CDS Start-End: 32-720
tttgcgcaggccccgctcccgccccgcctccatgcggcccgccccgattgcgctgtggctgcgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccgatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggg

SEQ ID NO: 169855 - DNA, 5756 bp, Homo sapiens
  Payload ID: 13436
  Gene Symbol: PCSK5
  Gene Name: proprotein convertase subtilisin/kexin type 5
  Uniprot ID: Q92824
  ENST ID: ENST00000376752
  CDS Start-End: 478-3219
cggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgcaacggaagagtcctgggcggaaggaggcttctgtatgcttgtgaaaaagaacaatctgtgccaacggaaggttcttcaacaactttgctgcaaaacatgtacatttcaaggctgagcagccatcttagatttctttgttcctgtagacttatagattattccatattattaaaaagaaaaaagccaaaaagaaaaaaaaaaaaagcaagccacctctctctttcttttcttgctctctttttctttctctctctctcaagtttgtgcagggagatggtgaactgttttgtcagaacttaaatggaaaaaaaaataaaactacaacaagcctaccttttataactgggtgtttagtgctaaacagccagaaccacagagacagtattgtatgaccaaagcatttgatgccaaaatttgacgttaaagtaatgatttgatttcctgccctggttttgaaggtccatttttttcccttttgcattgacttgcttgtttcccctttgaaacacctaaaaatacctttccaaaacatcgcgagagcatacatagacaaaaatgaaatagaaagctcttgcatgcttgagtccaccattgggggaaatgacagaaaactggacctgagggcattaggaacatcctacagagttgtgtttagtgtcgtttgccatggtatttcacagtgaaacatggatactctccacacatcatttacttcatgctgtgtacttatgtactggtttttgcattttactcacttgataagtctgctccactggtttcatcagatagacttgctgctactggcttttccattgtagattgggttattttacacgcagttcgccaaatgggattgctctgtatagtcaaattggtgatggacagatggacagaatgcagaggtacatagatgagctgaggctgatccagctcccctgaaattcagagtgttaactttgtagaccctgcacaatctcttggtgctatctagccattacccccattttttttttaaaggccatctgaaattccatttgtcatggtgggaagcattttggatatgatgcaggaaatctcttcctggagtcaaaagttcccaagaggtcctgtatttttaagaaatggaatttatttaaataatatttaagcttgtgcccatgttggccgggcaacttttttcaatggtgcttattagaagaagttttttcatcttgtcattttaagaaaataaaactggaaattgaatatgggtggcatgattgtacccttttagttctcttatttttctactcctctgtccctctataactatgccatactattatatgctggtccactgaatgctgagatgatctgttttttggggttttttttttttaagaaatattttcactggttttctgtgactctctaaacacttcatcgaaactagaagactgaattatgaggaaactatttggattagtggccagaaacgatgaaatcttatagatcttttgacagtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatccaaacagcaagctaggaaaaagcctgccttgaaaatatttctagacatcaaagataacttacaacccaaagtgaataataagtaaatagtctgatgaccctcttaatagcattgcaattgtattgaatcacataatgattcataagtaactagggaaccaactgattttgctaagcagtcttccccttataacaccacaggcccttctgacacacaaaaaaatgaaagttaatcctgggtacagcatacagttttacatttaaacgcacagtcttacgtggacaaatgcaagcacaagcctaaagcaaggtcaagcagatggcaaaaccgaatttgcctgcaaagaaatctatttaactgaatcagcccataatatttgaggcacgaggttactgtgattgataggaaagataaaaatgatgtctgtttttgtagacgaataaccatcaacatgacaacaaaattcattggggtctaccagcgtgcattccatttcccactgaccatgcaggtgcacgtcgcggaaatactggtttaactactagtgtgttactgcctcatttatctacataacattattaactagaacataatgctttcaaagtttaagttaatgttatatattatgtataaatatatatattcataatgagatatatgtaatggatagtacaaagtttggagactcaacaaatgctctaaccttctagagacaaaagtcctatttctgttttcttttgtctttttattttcaattagtgacccattgttaaatccaaatccacttttactgaaaaatactgtacatgtgtaaaatgttcagttgtttttttgtaaaatatagtagaacggttgtaactgatactggccaaaatcaatgttattccatattttattttttctattaaattaacctaagttcctgttta

SEQ ID NO: 169856 - DNA, 2845 bp, Homo sapiens
  Payload ID: 13436
  Gene Symbol: PCSK5
  Gene Name: proprotein convertase subtilisin/kexin type 5
  ENST ID: ENST00000376767
  CDS Start-End: 513-2585
attgccactcagaatcctcgcgcgctgctcggagccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatgaaatggaatggaatggaatggaatggaatggaatggaatcgaatcgaatcgaatcgaatagaatagaatagaatagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcattatttatc

SEQ ID NO: 169857 - DNA, 503 bp, Homo sapiens
  Payload ID: 13436
  Gene Symbol: PCSK5
  Gene Name: proprotein convertase subtilisin/kexin type 5
  ENST ID: ENST00000455778
  CDS Start-End: 1-306
tgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgtttctctgtttaggggagcctagactgatatcaagtttcttcatatcaaagcttcattggtgacctcatttgctttacaagtgaccagccatcttgcaggcttcatgcttctgagagccttacttagaagatgctgctggagtcacagctgaggagaggaatactatcaacatggactatcctgggaaagagctaggaagtagatgctgaggtccccatc

SEQ ID NO: 169858 - DNA, 4731 bp, Homo sapiens
  Payload ID: 13436
  Gene Symbol: PCSK5
  Gene Name: proprotein convertase subtilisin/kexin type 5
  ENST ID: ENST00000424854
  CDS Start-End: 1-4683
aacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacaaggatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagcttggatgatccaggaacatgtacatcttgcgctatggggtattacaggtttgatcaccattgttataaaacctgtcctgagaagacctacagtgaggaagtggaatgcaaggcgtgtgatagtaactgtggcagctgtgaccagaatgggtgttactggtgtgaagagggcttctttctcttaggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatgaagctgtgtccactgcaaacctatctgtggtgaagagcctgctgcaggagcgacgaaggtggaaagttcaaatcaaaagagatattttgagaaaactccagccttgtcattcttcttgtaaaacctgcaatggatctgcaactctgtgcacttcatgtcccaaaggtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagagattgccacaagtcctgcttgacctgctcatcatctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcaacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaagagtgcctgctccagtgcagggaaggatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggaaaaggagcgttgaattgtttatcctgtgtgtggagttaccacctcatgggagggatctgcacctcggactgtcttgtgggggaatacagagtgggagagggagagaagtttaactgtgaaaaatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgcaactgagcatttcaagacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccagtaaacaggcactcccccaccaacaccaccattccactctcaggcatgcctg

SEQ ID NO: 169859 - DNA, 9538 bp, Homo sapiens
  Payload ID: 13436
  Gene Symbol: PCSK5
  Gene Name: proprotein convertase subtilisin/kexin type 5
  Uniprot ID: Q92824
  ENST ID: ENST00000545128
  CDS Start-End: 539-6121
atttatgcagagcaggagctgctgccattgccactcagaatcctcgcgcgctgctcggagccggagggagcgctgggagcgagcaagcgagcgtttggagcccgggccagcagagggggcgcccggtcgctgcctgtaccgctcccgctggtcatctccgccgcgctcgggggccccgggaggagcgagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacaaggatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagcttggatgatccaggaacatgtacatcttgcgctatggggtattacaggtttgatcaccattgttataaaacctgtcctgagaagacctacagtgaggaagtggaatgcaaggcgtgtgatagtaactgtggcagctgtgaccagaatgggtgttactggtgtgaagagggcttctttctcttaggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatgatattttgagaaaactccagccttgtcattcttcttgtaaaacctgcaatggatctgcaactctgtgcacttcatgtcccaaaggtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagagattgccacaagtcctgcttgacctgctcatcatctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcaacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaagagtgcctgctccagtgcagggaaggatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggaaaaggagcgttgaattgtttatcctgtgtgtggagttaccacctcatgggagggatctgcacctcggactgtcttgtgggggaatacagagtgggagagggagagaagtttaactgtgaaaaatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgcaactgagcatttcaagacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccagtaaacaggcactcccccaccaacaccaccattccactctcaggcatgcctgtgagcatcactgtttttggttttatccccacaccaggctgatgtgtgagtttttctatttgtcttctttaaccatgagtccaaccagaatatgtaagaatgatgaaatactttgttcttcttttgagtggctaaactcaattaacagttcctgttcaaccgtaattgaagagcaaggataaaattcagaggcattttcctcaaaataatgtgttaagacacaaaaatgaaggaagtgaaaacaaatgagatttgtacaaactcttctatgtgattttaaaaaaaggacagcagatctatagaaattctgtttccgagctgcattgtggaggtgtctgctgcctcctggtattctaatttttctttatctaattttggggataatggaggtacaaaggagttgttggtttggtggtgtttttcttccctttagctgtctttaggcagaaatttgttttgtaagggccaagaaaagagggctcttatcaattgactccaggccacccctggtgagcagaagagaccacctgggctgggctgctcaggacctacttgagataagggaagaaaagagaaggtgcatcatagctgaggagccatgaggtcaccccaggccctagttcctccgcaggaatccagagtcacaacaattctaaaggcagagcaagcccagcgagaaagaaataactgaatttccaggaactgcactctcatgattttctgggtacttttcgcctgggagacatcagctaagacatcgaataataaaagaaaaatggcagtgttaacctaacataaaatggaataaaatgacaaacacttcatccgctctaaaaaattcagagctttccttcatcaacaacccatcacaaaaccgtggactctcaatagaaagagttggaatagagtctaacatggaaaaaaaaaaatcccaatatgctgctcacaagctgtactctagctgctgaccagccttccagcactgctcatcactatgatttttgtttctagacttcctaggcttccttttttccattcttctgtcaagtgtattcttggattcatgcaactgaggacagtttttgtccagattgtaacacagagaagggctcttgctatgcaaaatgatgttggcagggtcttacagatttccttgtcaaaatagaccttacaggcagtactagaaatggagcaccagaaagcaaaaatgacattttcagagaatgatgataattataatctattgcacacctactaccagataacaagctaagtaattcccccccaaaaatgccccacttatccattttggtacttaccatactcccatgaggttggtattgctattattctgttcttgtaggaaacctgaggcttacaagaggttaggtaactagtccaaggtcatgcaaagctcaacaaaattcaagaaaaaagaatgatcaccctaaagcgtgtgttcttataactatgctactgaaataaggtgggaaaataagcatcctaaatataattaaagtcatgcctattgttttagtctataatatcaatgttatctttactaaattcatggattttctttttttaacataatgtatcactgacacagaaaatctttatgaagaagtcttcagtttactaaaggcttgtgcttctttagaggaaagctcttaaaacagggttgacaaacagtctctggaaagagccagctagtaagtacattaggctttcttggccagaaagtctctgtcataaccactcagctctgctattatagcatgaatgcagctggtacataacggatgggtgagctgtgcttcaataaaaccttatttatggacactgacatttgaaattcaggtaattttcacatattataaaattttattcttcttttgatttttttcaaccttttaaaatttaaaaatgcaaaagctattctcagttcacagcattacaagaacaggtggtgggtcagatttggccaacaggctgtactttgctgactttatctttaaaacagttttcagagatcatacatgtacatgtatgatatgcctccaaaaattttgatcatttaaaattatctccttggccaggcgtggtggctcatacctctaatcctagcactttgggagactgaggcaggcagatcacctgaagtcaggagtttgataccagcttagccaacatggtgaaaccccatttctactaaaaatacaataaaaatctgggcatgttggtgcacacctgtaatcccagctactcaggaggctgaggcaggcaaatcacttgagcccgggaggcagaggttgcagtgagcggagatggcaccattgcactccagcctgggtgacagagcaagactccatctcaaaaaataagtaactaactaactaactaaataaataaataaataaaattatctccttgccaggactgctggctcatgcctgtaatcccagcactctgggaggctaaggcaggaggattgctgacccaccacctgttcttgagcccaggagttcgacatcagccttggacaacatagtgagactcccgtgtctacaaaaaatttaaaaattagccaggcatggtggcaagtgtctgtagtctcagctactcaggaggctaaggtggaaggatcacttgaacccgggaggtcgaggctgcagtgagctgtgatcttgctattgcacttcagcctgaatgacagagctaagaccctgactcaaaataaataaataacattatctcttcaaaatgtatctgaagccctgatagttctactttcaattcttagaaacatataaaaatatatgcatgatagccatcatatcaatggaagactttctcacctctgtggttgcagttagcttacaaaaacgagcaattttgcttatactgtgttgttcatcttccttgttaattctaaagctctgatagactgagtttgacatttctttctgtaaactggaaattgttttctatgaaaaaaaaactctatgatacacagttaaagattggttgaggttgagatgaacttcaatactaagaaaaattgtggtgttcctctgtgtggcctgcaatgaaaagaaggctcatgcttgtgtattgaggtttgacatctttccttctttgtttttagtcatgcaacgtcattcttagatggcttttgaatactatgctaatgactatctaaatagataaatatgtgattggaaaacaaagtcaccttttagttttctacttggaaatattaagagaatccttgtagactggaaacacaccaaaaggctgggtaaagcatgggaggttccagttaatagaaagtaattttaaaattggaaataaaattaaatcaagacca

SEQ ID NO: 169860 - DNA, 2309 bp, Homo sapiens
  Payload ID: 13437
  Gene Symbol: PCSK6
  Gene Name: proprotein convertase subtilisin/kexin type 6
  ENST ID: ENST00000331826
  CDS Start-End: 315-2309
tcgcgggccgaggacgcctctggggcggcaccgcgtcccgagagccccagaagtcggcggggaagttcccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagaggttcgtttccacactctcgattctgttccattggtctgtatatctatcttggagtcagtaccatattgttttgatcactgtagctttgtag

SEQ ID NO: 169861 - DNA, 3723 bp, Homo sapiens
  Payload ID: 13437
  Gene Symbol: PCSK6
  Gene Name: proprotein convertase subtilisin/kexin type 6
  ENST ID: ENST00000398185
  CDS Start-End: 1-2394
cagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaagagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggc

SEQ ID NO: 169862 - DNA, 3868 bp, Homo sapiens
  Payload ID: 13437
  Gene Symbol: PCSK6
  Gene Name: proprotein convertase subtilisin/kexin type 6
  ENST ID: ENST00000558864
  CDS Start-End: 1-232
gggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttgacttctgtccctgttcctatgctgaagggaaacttgtacaactttccctttttaaagtaaagagataccaccccactcttttttttttttaaacacagcaacagaagggccccaagttaaaaccagctctccagcctaaggactccacctggtggtcctctctggaattaaatgaagttgaggttttattttgtttaattttttcattattcagttattttgtttaacatttttagttattttgtttaaatttttagttattttaacttttaagttattttatttcttagttattttaacttgttattttaatttttttagttattttaactttttaaagttattttaattctttagttattttgtttaacttttttagtttttttagttaaacaaaagttgcagtgaccggggcaggtgtgatggctcaggcctgtaatcccagcactttgggaggccgaggcagggacagggggcaggggaaatcacttcttaggtcaggagctcaagaccagcctggcaaacatgacaaaaccccgtctctactaaaaatataaaaatcagccaggcatggtggcgagcgcctgtaatcccagctacttgagaggctgaggcacgagaatcacttgaacctcatgttattcctcatgaggcggaggttgcagtgagccgagattccgccactgtactccagcctgggcaacagagcgagactccatctcagaaaacaaagaagttccaagtacaatacaaagaaattccctcccaatttgagagtaagttgccgatataccctatgaccgccccccccccgccaatacttcagtgggtatttcctatgaacaacgacattctccggcacagccatcagactcaggaaattaacatcggtatgttattaccatcaaccctctgactgaattctagttctgccagttgtcccaataaagttcttagcaaaatggtctggtttagaaacacacttttcacttagtcatcatgtctctttaatgttcttccatctggaacagttcctcagtctccttgcctcatgatgtggaagcttttaaagactataggccagttatttgtaggctgcccttcgctgtgcacttgtctgagggttcctcacgttttgagtcaagtcatgcatctttgacacgaatctcacaggctgattctgtgttctgtctgcattctagcagggagtacacgatctgttccattattggtgatgttaacgatcattggttagagttttcttccgggctatgaagtgatgcctgccaaagcatatccactaccaccgctgttcaacattgtgctaaagatcccagccagtgtaacagggcaaaaaatacagaaccagtataataattggaaaggaggaaataaaactatcttttttttttttttttttttttttttttgagaccgagtctcactctgttgcccaggctggagtgcaatggcatgatcttcactcactgcaacctccgcctccctgattcaagtgattctcgtgcctcagcctcccaagtagctgggattacaggtacgtgccaccacacccggctaatttttgtatttttagtagaggcggggtttcaccatgttggccaggctggtctcaaactcctgacctcaggtgacccacccacctcagcctcccatagtgctgggattacaggcgtgagccaccacgcccagccaactatcattattctcaaatagcatggttatgtatgtagaaaatccacaagaatggttacagataaacttaagtaaatttcacaagatcgctggatgtaacgccaatatacaaaaatctgctgtatttaaatatatcaaactaatgattagaaaatggagtttttaaacaaaaggtactatttacagtagcatcaaaatctatcaaatatctagacaatctagtaaaggatatacaaggccttgacacaaaatctgcaggatgctgctgaaattaaagagtgcctcaataaatgtagggctataatatgcccattgattggaatacttcatattgtaaagatattaattctctccaaattcttctacagatccaacacactacaaatcaaatcatgggtgctttttcacatatatctataatttatgttcacatgcaaaggattagaataatcagataactactagataatctgagaaaaaaatgggagctttttttgagggacaaataccaagtctttttctaaagcttgtattctgcaaggatagctgactaaacccatggaaaagaacagctagttcagaagcagaggccctcacatatttggacacttgatttttgaaaagagctgctctgcagagcagtgggggagaagatggtcttttcaataaatggtgctgggtccaccaaatatccatatggggaaaaatatatcttcttccctaccttagactatgcacaaaaatctaggccagagagactgcagatctaaatggacaaggtggaagaagaaagcttttagaagaaaatataattttggagtaggcaaaagtttctcacagcgtactcgaaaactattagctgtatagggaacggttcataaatcagactgtattaaaatgaagaacctctattcatcaaaagataccattaagagagtgaaaacccaagccacagggggaagatactcactacagacatagctcacaaggttcctattgaaaaaatataaagagctcctacaaatcagtttaaaaataaagcccaatagaaaaatgggcaaaacacctaagcagacacttcattaaagaggttatccaaacaaacataaatatattttttaaagttctcaattgtgttagtaattagggaaatacagttaaaaccacaatttcataccattacctatctaccagaatggctaagattaaaaagacaatactaaacgttagcaaggagtttaagttggcaaccactttggaaaactatgtcctacttaagctgaacataagtaagccctatgacccagtaattccatccctgggagtatatcagtatatgtgttcacataaagatatatattattgagtttgtaggtacactatttataatataaaagagtgaaaattacccaaatgttcatcaacagcagaatggataagtaaattgtaaaacatccacaatgaaataccatattacagtgagaatagattaactacatctacacacaaacataatgtttagcaaaaaatatgcaaggtacttcatttgcataaatacaaaactagataaagcaaatctatacaagatggcaggataatggttacccttggggcaagggtggtgactagatgaagacaggaggagggcttctggaatgtggcaatgtcctgttcttacgaggatgctagttggttgggtgtgttcagtttgcattcttctatatgtatatcatacttcaataaaagttcaaggagaatc

SEQ ID NO: 169863 - DNA, 1035 bp, Homo sapiens
  Payload ID: 13437
  Gene Symbol: PCSK6
  Gene Name: proprotein convertase subtilisin/kexin type 6
  ENST ID: ENST00000559417
  CDS Start-End: 1-1035
tgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctggattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaag

SEQ ID NO: 169864 - DNA, 379 bp, Homo sapiens
  Payload ID: 13437
  Gene Symbol: PCSK6
  Gene Name: proprotein convertase subtilisin/kexin type 6
  ENST ID: ENST00000559605
  CDS Start-End: 1-379
gagcactcggaccagcgggtggtctacttggagcacgtggtggttcgcacctccatctcacacccacgccgaggagacctccagatctacctggtttctccctcgggaaccaagtctcaacttctggcaaagaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgca

SEQ ID NO: 169865 - DNA, 543 bp, Homo sapiens
  Payload ID: 13437
  Gene Symbol: PCSK6
  Gene Name: proprotein convertase subtilisin/kexin type 6
  ENST ID: ENST00000558951
  CDS Start-End: 1-378
gctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttga

SEQ ID NO: 169866 - DNA, 3336 bp, Homo sapiens
  Payload ID: 13437
  Gene Symbol: PCSK6
  Gene Name: proprotein convertase subtilisin/kexin type 6
  Uniprot ID: P29122
  ENST ID: ENST00000611967
  CDS Start-End: 28-1986
cgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattgatgaaaatgaaaatgacagatctgaggaagagggagagctctcttgaaacccctttcccagatttgccctcagttttaggaatgaggtacgcttgggcattcctgttgcctgcatggttcggcattctggcagccaggttcgccccagaatagataagtgtgtttgattttcgaacatttgactttattacctatttccagaaacacttcgtgttcaaactacgtctctacaggcatttctacttggtctttttctcccctgacatttcacagagtcctaactgtgctgcatgtataacttgttctttctttttgttacttgcatagcaagcatgtttctatgtcattaaatatcctttgtaagcagca

SEQ ID NO: 169867 - DNA, 2921 bp, Homo sapiens
  Payload ID: 13437
  Gene Symbol: PCSK6
  Gene Name: proprotein convertase subtilisin/kexin type 6
  Uniprot ID: P29122
  ENST ID: ENST00000615296
  CDS Start-End: 28-1899
cgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattg

SEQ ID NO: 169868 - DNA, 4269 bp, Homo sapiens
  Payload ID: 13437
  Gene Symbol: PCSK6
  Gene Name: proprotein convertase subtilisin/kexin type 6
  Uniprot ID: P29122
  ENST ID: ENST00000618548
  CDS Start-End: 75-2945
gagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatccc

SEQ ID NO: 169869 - DNA, 3132 bp, Homo sapiens
  Payload ID: 13437
  Gene Symbol: PCSK6
  Gene Name: proprotein convertase subtilisin/kexin type 6
  ENST ID: ENST00000622483
  CDS Start-End: 75-3002
gagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaa

SEQ ID NO: 169870 - DNA, 4409 bp, Homo sapiens
  Payload ID: 13437
  Gene Symbol: PCSK6
  Gene Name: proprotein convertase subtilisin/kexin type 6
  Uniprot ID: P29122
  ENST ID: ENST00000611716
  CDS Start-End: 170-3079
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggca

SEQ ID NO: 169871 - DNA, 3093 bp, Homo sapiens
  Payload ID: 13437
  Gene Symbol: PCSK6
  Gene Name: proprotein convertase subtilisin/kexin type 6
  ENST ID: ENST00000619160
  CDS Start-End: 75-2963
gagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaa

SEQ ID NO: 169872 - DNA, 462 bp, Homo sapiens
  Payload ID: 13437
  Gene Symbol: PCSK6
  Gene Name: proprotein convertase subtilisin/kexin type 6
  ENST ID: ENST00000621185
  CDS Start-End: 1-428
ccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaa

SEQ ID NO: 169873 - DNA, 1210 bp, Homo sapiens
  Payload ID: 13437
  Gene Symbol: PCSK6
  Gene Name: proprotein convertase subtilisin/kexin type 6
  ENST ID: ENST00000632686
  CDS Start-End: 151-1077
gagaacaacttcctgtgtcactgctgcagcggtgagaacaacttcctgtgtcactgctgcagcgggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcat

SEQ ID NO: 169874 - DNA, 4649 bp, Homo sapiens
  Payload ID: 13438
  Gene Symbol: PCSK7
  Gene Name: proprotein convertase subtilisin/kexin type 7
  Uniprot ID: Q16549
  ENST ID: ENST00000320934
  CDS Start-End: 632-2989
gatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggcttgtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaacaattctgccactcgcaatctctcctttcctctgtctccccaaagccactgcatgctgctgagtggctcctttttcccttcggtccccaagattcactctcctgttctatggcctgtttcctctgaaagaatctgactgtcctggaatcttggcacatgaagggtccttcagaggacggcagccaggaacacatacaagcccgagatgcctgcctgtcccctgcgcagatctgaaaccataacaaaagtgaccagggcaaatcaaactctgccagccaggcctgagaaaagattgattttttttttttttttttgagttccaaccccaaaaatattccaggacaagatagggggcaggctgggctggttcttcttcaatgggcttttgccgccaaggaggacagtggacttggcccacatccaggctacccccagcccgcttctcccctgcttagcccagggaggagacagtagaggtgatgggggcagccgggagggaggggccaaggcagtgatgctttcgggtaagaagttgggctgaggctgggggcacagggaggagctgcccaggtgcagttaccattgctcagtgacagagcctcaaagcttggccagggctgaaggtaccacacgggtgtgggtgaggcaggctaagcgggatggctgcagccaaggagctgggggagggccgggctcagggctagccctctccgctctaactgatgatctgccgaggtc

SEQ ID NO: 169875 - DNA, 1312 bp, Homo sapiens
  Payload ID: 13438
  Gene Symbol: PCSK7
  Gene Name: proprotein convertase subtilisin/kexin type 7
  ENST ID: ENST00000525027
  CDS Start-End: 397-1312
ctctgctaaagaacagtcacgatgcagccagtagtttgtggaagcgatgtgtgctttgagccctgtgggtggcaacaggggttgctcgcagtgcctgtgagcaactggacctcctgctggattagctggtgtcgtgaggattggctgtcttgctgtgggaggccatccgctggtgttagtgctggcccacactccacctgggggcttatccctgttggtcagggataaatgtgaacaaaaagagaagatcaaatgtttcacaatttaaaaggcatggcttagggacttccagggggaacacatggatggctcagcatctccctctcagattcctgcagttaccagctctttgatctcttccatatcctttttctttgtctgcagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaagg

SEQ ID NO: 169876 - DNA, 583 bp, Homo sapiens
  Payload ID: 13438
  Gene Symbol: PCSK7
  Gene Name: proprotein convertase subtilisin/kexin type 7
  ENST ID: ENST00000530269
  CDS Start-End: 309-583
gatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagct

SEQ ID NO: 169877 - DNA, 553 bp, Homo sapiens
  Payload ID: 13438
  Gene Symbol: PCSK7
  Gene Name: proprotein convertase subtilisin/kexin type 7
  ENST ID: ENST00000524507
  CDS Start-End: 215-553
ataatgtgggtgctaatgaggagaggggcacattgcacggagcgatcgaggccgacggagggagaatcgggaaactgacccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatc

SEQ ID NO: 169878 - DNA, 549 bp, Homo sapiens
  Payload ID: 13438
  Gene Symbol: PCSK7
  Gene Name: proprotein convertase subtilisin/kexin type 7
  ENST ID: ENST00000532301
  CDS Start-End: 272-549
gaagccgcgagtttccgcagggaggcggcggcagctgcggcggggccgagccgcttgggtgtgtatctgagtactaagccctgccccagggtggacccagtggagagcaaaggcttttaaaggagcccagccaccataggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttca

SEQ ID NO: 169879 - DNA, 3332 bp, Homo sapiens
  Payload ID: 13438
  Gene Symbol: PCSK7
  Gene Name: proprotein convertase subtilisin/kexin type 7
  ENST ID: ENST00000540028
  CDS Start-End: 202-1977
cactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttcc

SEQ ID NO: 169880 - DNA, 3637 bp, Homo sapiens
  Payload ID: 13439
  Gene Symbol: PCSK9
  Gene Name: proprotein convertase subtilisin/kexin type 9
  Uniprot ID: Q8NBP7
  ENST ID: ENST00000302118
  CDS Start-End: 291-2369
agcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaa

SEQ ID NO: 169881 - DNA, 2830 bp, Homo sapiens
  Payload ID: 13440
  Gene Symbol: PSAP
  Gene Name: prosaposin
  ENST ID: ENST00000394934
  CDS Start-End: 105-1688
ggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgtctcttcagcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccag

SEQ ID NO: 169882 - DNA, 2872 bp, Homo sapiens
  Payload ID: 13440
  Gene Symbol: PSAP
  Gene Name: prosaposin
  Uniprot ID: P07602
  ENST ID: ENST00000394936
  CDS Start-End: 155-1729
agaggcgctgagtcagggcgctgttgagctcgggcaggcccggatggggcggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccaga

SEQ ID NO: 169883 - DNA, 1969 bp, Homo sapiens
  Payload ID: 13440
  Gene Symbol: PSAP
  Gene Name: prosaposin
  ENST ID: ENST00000610929
  CDS Start-End: 105-827
ggggttagcgcctgcgctctggacggctttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccag

SEQ ID NO: 169884 - DNA, 500 bp, Homo sapiens
  Payload ID: 13440
  Gene Symbol: PSAP
  Gene Name: prosaposin
  ENST ID: ENST00000633965
  CDS Start-End: 1-500
ctgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaggatcagcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgt

SEQ ID NO: 169885 - DNA, 2688 bp, Homo sapiens
  Payload ID: 13441
  Gene Symbol: PSAPL1
  Gene Name: prosaposin-like 1 (gene/pseudogene)
  Uniprot ID: Q6NUJ1
  ENST ID: ENST00000319098
  CDS Start-End: 67-1632
aggagagccaggtttatagcagcagccactgctgggtactctggagccagagagtccctgggcagcatgctgtgtgccctgctcctcctgcccagcctcctgggggccaccagggccagccccacctcaggcccccaggagtgtgcaaagggctccacggtgtggtgtcaggatctgcagacagctgccaggtgcggggctgtggggtactgccaaggggccgtatggaacaaacccaccgcgaagtctctgccctgcgacgtatgccaggacatagcagccgccgctggcaatgggctgaaccctgacgccacggagtctgacatcctggctttggtgatgaagacctgtgagtggctccccagccaggagtcttcagccggatgcaagtggatggtggatgcccacagttcggccatcctgagcatgctccgtggggccccggacagtgccccggcacaggtgtgcacagcgctcagcctctgtgagccgctgcagaggcacctggccaccctgaggccactctccaaagaggacacctttgaggctgtggctccgttcatggccaatgggccccttaccttccacccccgccaggcgcctgaaggagctctgtgccaagactgtgtacggcaggtctcccgactccaggaggctgtccggtccaacttgaccttggccgacttgaacatccaggagcagtgtgagtccttggggcctggcctggccgtcctctgcaagaactacctcttccagttttttgtccctgctgaccaagcactgaggcttctccccccgcaggagctctgcaggaaggggggattctgtgaggagctaggggcacctgcccgtttgactcaagtagtggccatggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcacccatgccctggagcgcgtgtgctcggtaatgcctgcctctatcacgaaggagtgcatcatcttggtggacacctacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggacgcggagaaccagggcagcttctgcaatgggtgcaagaggctgctcacggtgtcctcccacaacttggagagcaagagcaccaagcgagacatcctggtggccttcaagggtggctgcagcatcctgccgctgccctatatgatccagtgcaagcacttcgtcacccagtacgagcccgtgctcattgagagtctcaaggacatgatggaccccgtggctgtgtgcaagaaggtgggggcctgccacggccccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggaacacgcgtgaccgtggctgccagagacccagagcctgctagcgaggcccatgaggtgggtgctttccccatccccatttcacaaatgaaaaactgaagctctgaggagggaggctgggaaggagcagagctgaagttcaaaaccaagtattcctgatcccgaaagcctctctcttaacaacggtgccgcacagctttgcccttgaaagcatctctactggaccggaacacactcatgtgccccgctccctgacccagccaaggctgccctctcatctccaaggctgagatgttgccggtggtcccatgagagcctgcccatgggctcaggtgcccctttaccttctgctggatggacatctggctgtgagccaggctggggtcatggccggggtgagcggaggcaggggtggacggaggcttcgagggcccatcactagtagggtcattacctcttgccaacagccgggggtgggagtctgggtctcgctcaggccagagcttctcaacctggagtccctgggggtggctgccaaaggtgtgtatgacaagcacgtatccctggacatttccggggagaggtctggggctttggtcacattctccaagggctgctgggcttcggagcagtccccccccatgtctcagccactacagggtccctctctctccttgcaccccagaccctccgctgccctggtaatgagcagaaggaaagtcttggggtgtgctcaaagtcaggagagcaaaatatgccaggcaaaagctcccgggaaaagccggaggagtctggggtggccaccgggatgtggagcagcgagggcaaagacggtgaacacagccctccagctgtctgagcctcagttttctaatctgtagaatggggatgatcatacctgcctcacaagaatgttgagacaattcacagagacgttctggagcccctttcccccgagaccggcattcatgagtctgctgggaccagaaaacccatctcaggggcccagcggggcacccaggagagtctggcggtgcaagcgctgtataaaccacaagcgttctccaaa

SEQ ID NO: 169886 - DNA, 8170 bp, Homo sapiens
  Payload ID: 13442
  Gene Symbol: PROX1
  Gene Name: prospero homeobox 1
  Uniprot ID: Q92786
  ENST ID: ENST00000261454
  CDS Start-End: 289-2502
cccctcgtgagtccctccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaactt

SEQ ID NO: 169887 - DNA, 8240 bp, Homo sapiens
  Payload ID: 13442
  Gene Symbol: PROX1
  Gene Name: prospero homeobox 1
  Uniprot ID: Q92786
  ENST ID: ENST00000366958
  CDS Start-End: 609-2822
aagtaaatcttgttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctcccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaagagagagagagagatagagagagagagagagagagagagagagaggctcggtcccactgctccctgcaccgcggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctc

SEQ ID NO: 169888 - DNA, 3075 bp, Homo sapiens
  Payload ID: 13442
  Gene Symbol: PROX1
  Gene Name: prospero homeobox 1
  Uniprot ID: Q92786
  ENST ID: ENST00000435016
  CDS Start-End: 273-2486
ccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaa

SEQ ID NO: 169889 - DNA, 900 bp, Homo sapiens
  Payload ID: 13442
  Gene Symbol: PROX1
  Gene Name: prospero homeobox 1
  ENST ID: ENST00000471129
  CDS Start-End: 211-900
ctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggagggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaa

SEQ ID NO: 169890 - DNA, 8498 bp, Homo sapiens
  Payload ID: 13442
  Gene Symbol: PROX1
  Gene Name: prospero homeobox 1
  Uniprot ID: Q92786
  ENST ID: ENST00000498508
  CDS Start-End: 617-2830
gtgtcttaaagtaaatcttgttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctcccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaagagagagagagagatagagagagagagagagagagagagagagaggctcggtcccactgctccctgcaccgcggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaactt

SEQ ID NO: 169891 - DNA, 560 bp, Homo sapiens
  Payload ID: 13442
  Gene Symbol: PROX1
  Gene Name: prospero homeobox 1
  ENST ID: ENST00000607425
  CDS Start-End: 132-560
gttactccccctgctgaagctgaaggttggtggagtgatggagcgtggggatggtaaaggaggaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttcccct

SEQ ID NO: 169892 - DNA, 3878 bp, Homo sapiens
  Payload ID: 13443
  Gene Symbol: PROX2
  Gene Name: prospero homeobox 2
  ENST ID: ENST00000556489
  CDS Start-End: 1-1779
atggatccaaactccatcttgctttctcctcagccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaaggtactattggatccaccaggccacctgactcagctgggcagaagcttccaggggcaggtggcagagggtagaagcgagccctcacctcctgtgggaggggcctgtaaagatccacttgctttggctgccttgcccaggagggtccagctacaagctggggtcccagtaggaaatttatcactggccaagcgtctagattctcctaggtaccctatccctccaagaatgacccccaaaccctgtcaggatcccccagcaaactttcccttgactgcaccttcccacatccaggaaaatcagattcttagccagctactgggtcatagatacaacaatggccattggagtagcagtcctccccaggactcatcttcccagaggcacccctcctcagagcctgccctacgaccttggagaactactaagccgcaaccattggtcctgagccagcagcagtgtcccttgcctttcacctctgcccatctggaaagtctaccccttcttccctcggtgaagatggaacagagaggcctgcatgctgtcatggaggcactgcctttctctttggtccacatccaggagggtctaaaccctggtcacttgaagaaggccaaactaatgtttttcttcacacgatatcccagctccaacctcctgaaggtttattttcctgatgttcagttcaaccgctgcattacctcccagatgatcaagtggttcagcaactttcgtgagttttattacatccaaatggaaaaatctgcccggcaagcaatttcagatggtgtcacaaatcccaaaatgctggtggttctccgcaattcagaactttttcaagctctcaatatgcactacaacaagggaaatgactttgaggttccagattgcttcttggaaattgccagcttgacgttacaggagttcttcagggctgtctccgcagggagagactcagatccttcctggaagaaacccatttataaaattatttcgaaactggacagtgacatcccagagatattcaaatcttccagctatccccagtagctgtttcggggttaagatcccacaacgtgaggagtgactggctagggtttcctgggtttgtcttaaagggcaatttagctgtagtcatataaaaagggcacaaggaaatctcctctatcaaaacaggtactattaccattttgatcatttatttccctttccagaatcatcagaaatttaactataaaatgtactaactatattggtgtattggtagtatattgtaaaaggaacacaagtttccaatcagaagacttgaagctcaactccattgtttccaggtgttgtgaccctgggaacttcctggtatctctgtatctgtaaaatgaggttgttaaggattaaaggacagtatgtcctatgcaatgtcattcacacacaaatgtcagttttttgagcccctctttcagataaggttatcttatttggggtttttacaaattgctgtttttagtcacctaattataaagcgccatctatttgctagatactttcacatactttaagcttttcaccctgaaaagtagttattatcatcatttaaaagatgaccaaacagaagctttagaactgcaaggtaactcgccaaagcctatgaggctaggacatctgggttgatagggacagtcaggagcctggaggaaccaagactttctgatgcccaactgcatgctggacccatctcctgcagctaactcaggatctcaagcaggaccccacccctagtaagcatccagcgctgacagggcaccgtcacctgacaactcctgcccagcacttaggagcacttcaccgcccaagatttctgctgatcatttcagcaaactcaagacaaactttatgcaggacttgagtgttgctgtttattcacatttgtctgctggaagagtttatcagctggataatgcaaatagtctccagctgaccattgcaattggtgccccaacctcatatatgcagaagaagctgaacttcagactgtgaaaggtagaaagggccttaggagatcatctggcccatgctgcttaaattgggaaggaagaaccgcagtccagacaggaggcttgcacaggctgtgcacagccttgcagatgataaatggcataactgggacaaatgcagcatcacacagaaatggaaattctcccactccataacaaaattacagtccatggctgaccttccactgatgaaggaattcatgaaatcaacatttccccctgctgctggcccagcacaattgtgacccactcttgagtatataggcaaggcatgtacaaagctgagtaactgcatctgtcttctaagctagtcaggatcaagtctttgtaagcactgccaaaggtacgccgggtggggtggggtgggggtaatacacagctcgggctttgtagtcctgataaggggtgtctgtgagttcattagcttctttcctgtctatataaaacaagtttcatattcggctactcaacttccataatttttctggtggggtgttgctggagcagatgagataaaatccctaaactattactagaactatcagcataaaaagtatgaaagatgaattttcctttgaattttctcttcaaacagctgaaaggaaaaacaaaacagacttagcccaaacccatctttacaggctaaaggttaagtgccctccagtacatccaattgcactcagaagatctttgccctattttcacaaaaatgaaggaatctgccaaacctaagttttaaacacaggcaagcatggagtgctctgagcaagggcaatcagttttctgtgtccggacatagtagaagaaccctctatccagagtgacattacatacctaagttagacatacaggggaaacaagttcacatgactgtccaatagagagcagcccttcttctgtcccaaacctgaaattcattagtgtgtgtttaaagactgagccaagtcacctccagggcagtgaaccttgtctcagggaccaatgagatgaaatgtacaagctcaaattgaaaacatttgtgtactgcagtctttccaggaagtgttctctaaccactgagctaaacacagaagaatgtataaatatgtatgctctgcc

SEQ ID NO: 169893 - DNA, 3359 bp, Homo sapiens
  Payload ID: 13443
  Gene Symbol: PROX2
  Gene Name: prospero homeobox 2
  Uniprot ID: Q3B8N5
  ENST ID: ENST00000556084
  CDS Start-End: 1-1098
atggatccaaactccatcttgctttctcctcagccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaagttcaaccgctgcattacctcccagatgatcaagtggttcagcaactttcgtgagttttattacatccaaatggaaaaatctgcccggcaagcaatttcagatggtgtcacaaatcccaaaatgctggtggttctccgcaattcagaactttttcaagctctcaatatgcactacaacaagggaaatgactttgaggttccagattgcttcttggaaattgccagcttgacgttacaggagttcttcagggctgtctccgcagggagagactcagatccttcctggaagaaacccatttataaaattatttcgaaactggacagtgacatcccagagatattcaaatcttccagctatccccagtagctgtttcggggttaagatcccacaacgtgaggagtgactggctagggtttcctgggtttgtcttaaagggcaatttagctgtagtcatataaaaagggcacaaggaaatctcctctatcaaaacaggtactattaccattttgatcatttatttccctttccagaatcatcagaaatttaactataaaatgtactaactatattggtgtattggtagtatattgtaaaaggaacacaagtttccaatcagaagacttgaagctcaactccattgtttccaggtgttgtgaccctgggaacttcctggtatctctgtatctgtaaaatgaggttgttaaggattaaaggacagtatgtcctatgcaatgtcattcacacacaaatgtcagttttttgagcccctctttcagataaggttatcttatttggggtttttacaaattgctgtttttagtcacctaattataaagcgccatctatttgctagatactttcacatactttaagcttttcaccctgaaaagtagttattatcatcatttaaaagatgaccaaacagaagctttagaactgcaaggtaactcgccaaagcctatgaggctaggacatctgggttgatagggacagtcaggagcctggaggaaccaagactttctgatgcccaactgcatgctggacccatctcctgcagctaactcaggatctcaagcaggaccccacccctagtaagcatccagcgctgacagggcaccgtcacctgacaactcctgcccagcacttaggagcacttcaccgcccaagatttctgctgatcatttcagcaaactcaagacaaactttatgcaggacttgagtgttgctgtttattcacatttgtctgctggaagagtttatcagctggataatgcaaatagtctccagctgaccattgcaattggtgccccaacctcatatatgcagaagaagctgaacttcagactgtgaaaggtagaaagggccttaggagatcatctggcccatgctgcttaaattgggaaggaagaaccgcagtccagacaggaggcttgcacaggctgtgcacagccttgcagatgataaatggcataactgggacaaatgcagcatcacacagaaatggaaattctcccactccataacaaaattacagtccatggctgaccttccactgatgaaggaattcatgaaatcaacatttccccctgctgctggcccagcacaattgtgacccactcttgagtatataggcaaggcatgtacaaagctgagtaactgcatctgtcttctaagctagtcaggatcaagtctttgtaagcactgccaaaggtacgccgggtggggtggggtgggggtaatacacagctcgggctttgtagtcctgataaggggtgtctgtgagttcattagcttctttcctgtctatataaaacaagtttcatattcggctactcaacttccataatttttctggtggggtgttgctggagcagatgagataaaatccctaaactattactagaactatcagcataaaaagtatgaaagatgaattttcctttgaattttctcttcaaacagctgaaaggaaaaacaaaacagacttagcccaaacccatctttacaggctaaaggttaagtgccctccagtacatccaattgcactcagaagatctttgccctattttcacaaaaatgaaggaatctgccaaacctaagttttaaacacaggcaagcatggagtgctctgagcaagggcaatcagttttctgtgtccggacatagtagaagaaccctctatccagagtgacattacatacctaagttagacatacaggggaaacaagttcacatgactgtccaatagagagcagcccttcttctgtcccaaacctgaaattcattagtgtgtgtttaaagactgagccaagtcacctccagggcagtgaaccttgtctcagggaccaatgagatgaaatgtacaagctcaaattgaaaacatttgtgtactgcagtctttccaggaagtgttctctaaccactgagctaaacacagaagaatgtataaatatgtatgctctgccaacagaagaattctatttgattataattttctgtttctatcaagtgcgtatccctctctgttggaaacacatggagtgtaagctgagtgggttattattttagcaatcatactttgccaaagatctggtcattttttccactaaggtatatgagggcactat

SEQ ID NO: 169894 - DNA, 550 bp, Homo sapiens
  Payload ID: 13443
  Gene Symbol: PROX2
  Gene Name: prospero homeobox 2
  ENST ID: ENST00000619947
  CDS Start-End: 527-550
atagacccacagggagaaaggctgccatgtaggaggtgatctgtgcaggtgatgatgccacagacactggctgttccttttcagctcatgccccggtgctctaacacaaagctgaaaggagacaacacacaacttctctcagacagggtcttactttgttgcccaggctggaatgcagtggctattcattggcatgatcgtagcacactacagctttgaactcctgggctcaagcagtcttcccacctcagcttcctgagtagctgagactacagactgcctgttccaggagggcagactatgctgatcttgctcactccatgagcccagaagaaggcccgacacacagcaggagtctgcccaggaggttcatgagccctggcatcccagaatctgaatccttcctcagtgacagtggctctttacccttctaagtgcagaggaggaagcccagcgcattctgggtgcacttccagctgaggaaataaggaggaggaattcctgaagccctgaacaagtgcctgggatggatccaaactccatcttgctt

SEQ ID NO: 169895 - DNA, 2942 bp, Homo sapiens
  Payload ID: 13444
  Gene Symbol: PTGDR
  Gene Name: prostaglandin D2 receptor (DP)
  Uniprot ID: Q13258
  ENST ID: ENST00000306051
  CDS Start-End: 103-1182
cgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacattttcagtcaaagaaccatgattaaaaaaaaaaagacaacttacaatttaaatccttaaaagttacctcccataacaaaagcatgtatatgtattttcaaaagtatttgatatcttaacaatgtgttaccattctatagtcatgaaccccttcagtgcattttcatttttttattaacagcaactaaaattttatatattgtaaccagtgttaaaagtcttaaaaaacaatggtattaattgtccctacatttgtgcttggtggccctattttttttttttagagaggccttgagacatacaggtcttttaaaatacagtagaaacaccactgtttacgattatacgatggacattcataaaaagcataatttcttaccctattcattttttggtgaaacctgattcattgattttatatcattgccgatgtttagttcatttctttgccaattgatctaagcatagcctgaattatgatgttcctcagagaagtgaggtgggaaatatgaccaggtcaggcagttggaggggcttccccagccaccatcggggagtacttgctgcctcaggtggagacctgaagctgtaactagatgcagagcaagatatgactatagcccacaacccaaagaagcaaaaattcgtttttatcttttgaaatccagtttcttttgtattgagtcaagggtgtcagtaggaatcaaaagttgggggtgggttgcaaaatgttctttcagtttttagaacctccattttataaaagaattatcctatcaatggattctttagtggaaggatttatgcttctttgaaaaccagtgtgtgactcactgtagagccatgtttactgtttgactgtgtggcacaggggggcatttggcacagcaaaaagcccacccaggacttagcctcagttgacgatagtaacaatggccttaacatctaccttaacagctacctattacagccgtattctgctgtccgtggagacggtaagatcttaggttccaagattttacttcaaattacaccttcaaaactggagcagcatatagccgaaaaggagcacaactgagcactttaatagtaatttaaaagttttcaagggtcagcaatatgatgactgaaagggaaaagtggaggaaacgcagctgcaactgaagcggagactctaaacccagcttgcaggtaagagctttcacctttggtaaaagaacagctggggaggttcaaggggtttcagcatctctggagttcctttgtatctgacaatctcaggactccaaggtgcaaagcctgctgcatttgcgtgatctcaagacctccagccagaagtcccttccaaatataagagtactcatgtttatttatttccaactgagcagcaacctcctttgtttcacttatgttttttccagtatctgagataatataaagctgggtaattttttatgtaattttttggtatagcaaaactgtgaaaaagccaaattaggcatacaaggagtatgatttaacagtatgacatgatgaaaaaaatacagttgtttttgaaatttaacttttgtttgtaccttcaatgtgtaagtacatgcatgttttattgtcagaggaagaacatgttttttgtattctttttttggagaggtgtgttaggataattgtccagttaatttgaaaaggccccagatgaatcaataaatataattttatagta

SEQ ID NO: 169896 - DNA, 1216 bp, Homo sapiens
  Payload ID: 13444
  Gene Symbol: PTGDR
  Gene Name: prostaglandin D2 receptor (DP)
  Uniprot ID: Q13258
  ENST ID: ENST00000553372
  CDS Start-End: 4-894
gccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgcatttgttcctggagtccccgccaagacacctgggagtaggtgaggcttgaggaaacattttcagtgctgctcctctcctttctcccaagtatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacat

SEQ ID NO: 169897 - DNA, 2895 bp, Homo sapiens
  Payload ID: 13445
  Gene Symbol: PTGDR2
  Gene Name: prostaglandin D2 receptor 2
  Uniprot ID: Q9Y5Y4
  ENST ID: ENST00000332539
  CDS Start-End: 113-1300
cagcctccctctcccacctctgtctgcccgctgcctcttgtctagctgctgtcaggagctgactgcctccagggctggaatcctgtgctccctctgtgcccagagccccacgatgtcggccaacgccacactgaagccactctgccccatcctggagcagatgagccgtctccagagccacagcaacaccagcatccgctacatcgaccacgcggccgtgctgctgcacgggctggcctcgctgctgggcctggtggagaatggagtcatcctcttcgtggtgggctgccgcatgcgccagaccgtggtcaccacctgggtgctgcacctggcgctgtccgacctgttggcctctgcttccctgcccttcttcacctacttcttggccgtgggccactcgtgggagctgggcaccaccttctgcaaactgcactcctccatcttctttctcaacatgttcgccagcggcttcctgctcagcgccatcagcctggaccgctgcctgcaggtggtgcggccggtgtgggcgcagaaccaccgcaccgtggccgcggcgcacaaagtctgcctggtgctttgggcactagcggtgctcaacacggtgccctatttcgtgttccgggacaccatctcgcggctggacgggcgcattatgtgctactacaatgtgctgctcctgaacccggggcctgaccgcgatgccacgtgcaactcgcggcaggtggccctggccgtcagcaagttcctgctggccttcctggtgccgctggcgatcatcgcctcgagccacgcggccgtgagcctgcggttgcagcaccgcggccgccggcggccaggccgcttcgtgcgcctggtggcggccgtcgtggccgccttcgcgctctgctgggggccctaccacgtgttcagcctgctggaggcgcgggcgcacgcaaacccggggctgcggccgctcgtgtggcgcgggctgcccttcgtcaccagcctggccttcttcaacagcgtggccaacccggtgctctacgtgctcacctgccccgacatgctgcgcaagctgcggcgctcgctgcgcacggtgctggagagcgtgctggtggacgacagcgagctgggtggcgcgggaagcagccgccgccgccgcacctcctccaccgcccgctcggcctcccctttagctctctgcagccgcccggaggaaccgcggggccccgcgcgtctcctcggctggctgctgggcagctgcgcagcgtccccgcagacgggccccctgaaccgggcgctgagcagcacctcgagttagaacccggcccacgtagggcggcactcacacgcgaaagtatcaccagggtgccgcggttcaattcgatatccggactcctgccgcagtgatcaaagtccgaggggcgggacccaggcacctgcattttaaagcgccccgggagactctgaatctttttcagaaacagtgagttaaagcagtgcttctcaaaccttgatgtgcctgtgaatcacctaggggtcttgttaagtgcagtctgatccaggaggccggggccgggtactgagagtctgcacttaacaagctcccaggccgagaagccagtgcggcaggttcacaggcgaggcctggagtaacacaaagtgaaactcataatagacttcccactctagggcagtggagtcggaagggcacacggggtgcgtctccccggagttcagttttaccagatgatgggggaggggggaaggagttttatgttaaaccatccatgtatttttggagaagagagaggaaaggtttgagaagcactgttccagcctgccctcttcatttagccaatgcttactgcgctagacgcttcatcccacaatcttaaggggcagcttctattagccagtctttacagctgagcacattctggctcagggaggttaagtgacttgcccagtttcagggctaacgaccacagggtctgcactctaaccctaggcatcacatgctcaatgactctctggtgagcgaggacattctctgacctactcgagggacttaagatgctaccttgtgacccagcactgcccaaagtgcttccaaggcagaagcagcaggggatggcgtggtcaagcactcgggaaacctggggctaatcaaatccaatgggggaaatgactaaaagtcttcggtcgttagaagttgaatgggcacagcaactctaagactacagcacacgtcatttcttagctaagcggaccagcctccctgtcggcctggtgttctgtgggatccctctgggcactggtaatcccaagatctgtgcagccccgcctccaggccacatggggctgggcagctaccatttcccttttgcggatgggaggggtaacttgcacctctgacctatcacttccactgcaccccgtctcattcctccacctgccgtggacttggggtcagagactgctgtgtttgagctctgcagcccagggaccgaaaagttggtgtcaatgaattttgcttggtggatgaaatgtcagtggaagaagcagatgagaaactcttgagatcttggtcctgtgttttttctgccaccaaaggccagggtcactgaaggcctggcccacagcaggtgctgagcaaagggaacagtgaggtgcccagctagctgcagagccaccctgtgttgacacctcgcccctgctccctcccatcccttccccctttactcatagcacttcccccattggacacgtggtgcattttgcttgtttattatgttttctctccatcagaatgaaagctcctcgagggcagggactttggtctattgtctgtatttgccggtgcctaggattgtgcctgtatgcaacaggcactcaataaatatttttgctgta

SEQ ID NO: 169898 - DNA, 807 bp, Homo sapiens
  Payload ID: 13446
  Gene Symbol: PTGDS
  Gene Name: prostaglandin D2 synthase 21kDa (brain)
  Uniprot ID: P41222
  ENST ID: ENST00000371625
  CDS Start-End: 75-647
ctcctcctgcacacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtc

SEQ ID NO: 169899 - DNA, 661 bp, Homo sapiens
  Payload ID: 13446
  Gene Symbol: PTGDS
  Gene Name: prostaglandin D2 synthase 21kDa (brain)
  ENST ID: ENST00000457950
  CDS Start-End: 75-661
ctcctcctgcacacctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaa

SEQ ID NO: 169900 - DNA, 370 bp, Homo sapiens
  Payload ID: 13446
  Gene Symbol: PTGDS
  Gene Name: prostaglandin D2 synthase 21kDa (brain)
  ENST ID: ENST00000444903
  CDS Start-End: 1-187
aggataccattgtcttcctgccccaaaccgtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagtcagta

SEQ ID NO: 169901 - DNA, 553 bp, Homo sapiens
  Payload ID: 13446
  Gene Symbol: PTGDS
  Gene Name: prostaglandin D2 synthase 21kDa (brain)
  ENST ID: ENST00000446677
  CDS Start-End: 1-375
gtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgcccctggcttctttcttggcagataagtgcatgacggaacaataggactccccagggctgaagctgggatcccggccagccaggtgacccccacgctctggatgtctctgctctgttccttccccgagcccctgccccggctccccgccaaagcaaccctgcccactcaggcttcatcctgcacaataaactccggaagcaagt

SEQ ID NO: 169902 - DNA, 989 bp, Homo sapiens
  Payload ID: 13446
  Gene Symbol: PTGDS
  Gene Name: prostaglandin D2 synthase 21kDa (brain)
  Uniprot ID: P41222
  ENST ID: ENST00000471521
  CDS Start-End: 62-634
cctccctcgctctcccacaccactggcaccaggccccggacacccgctctgctgcaggagaatggctactcatcacacactgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaatagttccagggcacctggtacatggtcggggtggtgtcagatgaccaggacttcctggactccaaggacaccatgaagatggctgtggtcttagtgacccccttggggaatggtgacctggccctcaagtttggataccccacgccccatggcgggtgccagaaaatggacacgaccttcaccgagggtgctgtaccggggcagttcagcaacccagctcgagcgcccgagctgtttcccgaaggcgcccagaagatgcagctactggcgccccaagtgggcctgagccccagccagggcgtcctgctgccgaagtcggaccagtgtgcgggcgcgctctcccgggtgagtagaccat

SEQ ID NO: 169903 - DNA, 1421 bp, Homo sapiens
  Payload ID: 13447
  Gene Symbol: PTGER1
  Gene Name: prostaglandin E receptor 1 (subtype EP1), 42kDa
  Uniprot ID: P34995
  ENST ID: ENST00000292513
  CDS Start-End: 119-1327
ggaagagggagggaggaagcggcttgccggagagccagggcgcagtgggcggcagggctgagcggccggtgatggggaccccacatcccaggcagtgccggcacccctggcgcctgacatgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccgccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgctacgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaagcacaaccagaggcccaacgactaagccagcccaccctgggctgggcccaggtgcgcggcgcagagcctttgggaataaaaagccattctgcga

SEQ ID NO: 169904 - DNA, 2383 bp, Homo sapiens
  Payload ID: 13448
  Gene Symbol: PTGER2
  Gene Name: prostaglandin E receptor 2 (subtype EP2), 53kDa
  Uniprot ID: P43116
  ENST ID: ENST00000245457
  CDS Start-End: 155-1231
gccgccgtcggcgcgctgggtgcgggaagggggctctggatttcggtccctcccctttttcctctgagtctcggaacgctccggctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccttggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcagtgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactctttatttatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttagggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacaaaaatttgaaaa

SEQ ID NO: 169905 - DNA, 643 bp, Homo sapiens
  Payload ID: 13448
  Gene Symbol: PTGER2
  Gene Name: prostaglandin E receptor 2 (subtype EP2), 53kDa
  ENST ID: ENST00000557436
  CDS Start-End: 277-588
ggccggcgcgggtaggcgcgggagcctcgagcgccgctcggatgcagcagccgagccgccactcggcgcgcggcgggagacccagggcaagccgccgtcggcgcgctgggtgcgggaagggggctctggatttcggtccctcccctttttcctctgagtctcggaacgctccggctctcagaccctcttcctcccagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaat

SEQ ID NO: 169906 - DNA, 1404 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000351052
  CDS Start-End: 232-1404
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaaggtga

SEQ ID NO: 169907 - DNA, 2333 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000306666
  CDS Start-End: 212-1384
gaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgacatataaaagcaaatgagggcaggagggaatcgtgacaaaaaatatttgtgcccaattatgattaatgttttagagatgttgtgtccctgtgggcttagcatggaactaaaagttcctaagtctcaattctagttatgtgtcatttagtaactcaggaatctgcttaattgttatttctaagcttttgatgacaaaggagtgatgcagctaagggcatccttggagtgtcataaaaaacaaatttgaggttgaatgattagctgcgcagttagagtgataaaaaaatccaggtaggccttctgattcaccatgaccaagtcaggatttcttaatatttcttttctggcagcatatacaaaggcaaaattaataaataacagttgttgaataacaaactttattacgtttttataaaataaaagaatctattttgtctgtattaaaataaaaaactttgtggacttctaaaagat

SEQ ID NO: 169908 - DNA, 1470 bp, Homo sapiens
  Payload ID: 13449
  Gene Symbol: PTGER3
  Gene Name: prostaglandin E receptor 3 (subtype EP3)
  ENST ID: ENST00000354608
  CDS Start-End: 232-1470
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagttgaagaaacaaaagttgagatcaaagatagggtcttactctgtcccgaaggctagagtgccatggtgtgatcataactcgttgcagcctcagcctcctggcttaaaatatatattcatctcccaggttcaagctattctcctgcctcagcctcccaagtag

SEQ ID NO: 169909 - DNA, 1943 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000356595
  CDS Start-End: 212-1468
gaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaattaatctgcagtttgcagaactctcagatacagagggcaactgcacattgtgggcaagtacaaacctatcgtgtgctgaacagagaagaaatggaggtactcgtgagcagcattaatgtgtacaccagaatctcaacagtaaagacagaataacatgaagaaaataactacaggagtgctgtgttttaaaaaagcaagctcctccagctgagtttgtgactctaatccctgcttattttgagcactttccatgtgttgattgactcggaaaggtgggagattaccagcaagccaggtcatttgggcaaacatgggcatatttttagcaaagctgaacaaactggttggtcactcgaactacccaatttagacttatagtaagaatagcacatggttcagaattgccaagactgctgctttagtcaacagaaattttttcatatgcatgctggtaatgcagtgcatctctggaagaaatgcaagagtattttaacatttggtccagaagaaatatgtaaagggtgtttgtagaatttgatgccctcttcagtgacataaggttatgggtttgtgaatggaaaatctgttatttgttcaggttattaaaacacattctaattcaacatca

SEQ ID NO: 169910 - DNA, 6982 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000370924
  CDS Start-End: 232-1398
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttttggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaacattttttataaatgatcttggtctattggggagcggggatagttaatattccagtacactgaatacatgaggaatttaaccacatacatcattgaagacaagggatagcagtttgtttttattcaaagacattgctgtgttctctttcattgcctctctcgctttctgtcacttttttcctccttacattaaagaaaagtttaattacagttaaaaatgtataatgtatttataatattcatcgataccattattcaaatattgctcaatacagcaaattagctcctaacctaacaaagtttaagtttacttggattgataattaggtttactctttatctgaataagaaccaattccatttgtttgaaatatggagtttgtgactacccaaattgctaattattctttcttttgaatatattttacatttctatgagcctaaggaagattcatgaaactgacctatgagagtcgtgaagtggtttttcagaatgctatgtaaggaccgatttgagcactaactataggtactctgaatatatatttcccttgattattcaccaaaagtgttccccagtctttgactctttaaattccaatactgattccaaaacaaataaatattttgaagactcaatgaatactttccatattttggcctatttatataagaaagttaataacattgacccttcacagctcttctgcctgctcctcaaagtggctctatctaaatatttattactaaaatgtttttcctacagtctacatgaatacaaacctcaatagctaagcttgacgtatttgtgcacaagtagatcactacattaagttttgggaattgcacttcttaaaaatgtctccccaccaaacatagtaatcctgtagttatgcctacacaaagcttgccatattctttggtgcattcattttgtaaacccattaactttttattgtgaagattttcatttgcagtttcttgcactgcttttctagttttttaaaagcttgagatttatttatacttcttgtagtaactgcatatttctgtgtgtgtttagtggtaaagaattaattttgataggtacaatatgtctatcagattgatatatacaccagcctatgtcaattggggctaattattttaaatgaccatgtcaaattgaatttggagacaaaatctgttgagagtgcttatgtaattaatgatggttctactaatctaaattttggaaaaggtgataaatagactatactaaaatctctctatgccatagaattggattatcctgtaggtcatctcattgggtataagacaaaactacctactttttttcaaaagtgcactgaaatcacataataaagaggctttacctcttggttggtcctgtgaccctaagttctagtcagatagacacagaggcaatgtgaatttgagtggcatgagcatgattaggttattccttccagcatctagtatagcacctggaatatagaaactgtctaatacatatttattcagtgaatcaatgagcagaagtttgccaggacagtacacattggcaaggcacataccatatgattgaagtgcttcatgccattacagtccatcaggctgataaagtgaattatttctgattatttaattacagaaatatgaatttatcttcaagggtgtagtgtcatactgctgtacaacacagtgctttatttatactaataatttaggagactgatacttccaaatgatagtggacattactatcacaagaatatcacttttcatcaaactgcaaaaatacagaaaggcaaaaaacctgacacttattcttaactgcaaattaaattcctgcccaggggatatattttaggaggggatgaatggcagcttttgtgttttttttaacaagcttgaaagggaggtggaaaacaaagaaattatgtaaatggcatatgagttttattatctaggcattcgttagtatggggaaacctgataagaaatgaaaatcccaaatgatttcagccttttcatgatggttgaggttagatttcagagatgtacagagactagagcggtggttagaaagaggatatatgtagtcacagcagaaagacgtgtctaagtttaattttattggctttcaagttcactcatgtatacttagtttgtccatacatatgtctaatcaggaaaaatgcatgtatagattatgacaattcctgaattttgaagtattggttaaaagacaattaaaggccaagaaaaccatggtggaagaagtaagcgaatgaaatgtagaaatatatgtaaaattagcaagtgtcaattttaccaagtagtgttgattttccaaacaatgaatttatatactatgctgagtcacagagaagaatgatcacatgttacttaatgagagcagtttacttttcaaataaaataggtatgatgaatgtcttaaaaatatcttgaagttgaagaaacaaaaatgagttatctcaatatttaccaagttaacctagtgctgtatatatcccaagatattttaggtaaatgtaagtgtttaatcatgccagatttaaactagtctgaaatatagggtatacatatatttctacttacatttctttattttatgaaatatccgaccatgttgcagaaaataatgcaaaacctcatgtaagttaactatgaaagatcctgtgagcacattggcattgagtgacagacaaactaaaaactggcaaacagtattttaataagggggtcactctgtggcagtattctaatattggattttcaagtagattaggctttttatttattcaacgctttttataattttgttctttttgactccaaattattggtcagctttcaaccttctccacatcagcaatcactaatagttcttttggttgagatcaactcagaaaaagaaaatagaaaacttttgttctttgaaattttagacatgcataatatctatttattttcataatttaaccccaaaagcttctcctgcaatacacaggattctaggagctgaatgacacagggagactacagagtatttattattacaaacacataaaaagcctaacttgaagaattaaaatttctattttttatctgtataacaagtacaaaccatcaacaatgacaaattttcacagctgcttgtttattgcttgttttatatgtttacatatctcaaaatctgttaaaactgaggtctaaaaaatgtgcagaattgtgcaactgtggcctagtccataagacttttctgagttgcaacaaagtgctgacaaagtgacagatgtctgtgatgtttcatgacataggttatgatcgagccaatttacaaaatttaataaccaacctaaactcacatacatatttgttaagaagctgacatcagttcagtattgtaaggaaactaactaggtggtgatgatgataaaagaattagggaaaatattttatttgatatattcccttttataattcctaaaatgaagattctatttaagggttataatttatataagtttagtcatataccattacattatgataccataagcagagtgcattatgattctctagaaatataattcaatcagatatgtattatatttatttatgtcacacattttctttactgagaataaaaattatcttattttcagaagctttgtatcaatcagtttcatgtaataagcaacccagatatctactagattatgtatttcttcatttgaaactacactgttttctcctagtccccttgactctactgtgcttatccattctttcacagaaagaaagtaacagacataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgccaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaatgtcgctgtgttttcttcctgatgtcaactcacgtcaggaatactttacctataactatgttaagtattttgctgaaatcccatttgatgtgctttgtcaaataatagcacaatgtaatgcaacagccccatgctatctggaaaaattagatcattttgttttatattccataatcatgtgcataacaaattattgttgatttaatataaatatgagagttgctcttt

SEQ ID NO: 169911 - DNA, 1914 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000370931
  CDS Start-End: 212-1384
gaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgttt

SEQ ID NO: 169912 - DNA, 1841 bp, Homo sapiens
  Payload ID: 13449
  Gene Symbol: PTGER3
  Gene Name: prostaglandin E receptor 3 (subtype EP3)
  ENST ID: ENST00000370932
  CDS Start-End: 232-1398
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctcgttttccaggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgttt

SEQ ID NO: 169913 - DNA, 1447 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000460330
  CDS Start-End: 57-1181
tgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgt

SEQ ID NO: 169914 - DNA, 1895 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000479353
  CDS Start-End: 232-1413
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggagatggggcctgatggaaggtgtttttgtcatgcatggaggcaggtccccaggacttggtgcagttctcatgatagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtac

SEQ ID NO: 169915 - DNA, 1971 bp, Homo sapiens
  Payload ID: 13449
  Gene Symbol: PTGER3
  Gene Name: prostaglandin E receptor 3 (subtype EP3)
  ENST ID: ENST00000497146
  CDS Start-End: 212-1489
gaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagctcctcttcttcccacctctactgtgattgatccttcaaggttctgtgctcagcccttccgttggttcttggatttgtcctttcccgccatgtcttcatcacatccacaacttccactaacacttgcgagcttcaaacttcttagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtac

SEQ ID NO: 169916 - DNA, 1922 bp, Homo sapiens
  Payload ID: 13449
  Gene Symbol: PTGER3
  Gene Name: prostaglandin E receptor 3 (subtype EP3)
  ENST ID: ENST00000361210
  CDS Start-End: 232-1440
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatgagaaaaagaagactcagagagcaagagatggggcctgatggaaggtgtttttgtcatgcatggaggcaggtccccaggacttggtgcagttctcatgatagagaaccctgcagtgtccagctaagctgatgacttgaagataaatctgcctaaccctgggatgaagtatctgtgaactattttgacagcagatgaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtac

SEQ ID NO: 169917 - DNA, 1815 bp, Homo sapiens
  Payload ID: 13449
  Gene Symbol: PTGER3
  Gene Name: prostaglandin E receptor 3 (subtype EP3)
  Uniprot ID: P43115
  ENST ID: ENST00000628037
  CDS Start-End: 232-1329
accagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggaggaattttggggaaattaaaacctgcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgtttccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtattccataatttgaataaagcataatttgtttgtacaatctcccgccaagggaaaattatttccacactcatcatgacaaggagcactgcaaaaataaaaataaaaattacattcatacatgttt

SEQ ID NO: 169918 - DNA, 3848 bp, Homo sapiens
  Payload ID: 13450
  Gene Symbol: PTGER4
  Gene Name: prostaglandin E receptor 4 (subtype EP4)
  Uniprot ID: P35408
  ENST ID: ENST00000302472
  CDS Start-End: 1025-2491
aaaacaactgccctctcttccacgatctagatgttgcggcccgcggacaggaggttcaagaaatagtacactccgagcggcaggcagcgaggcggaaacggtcgccggtttcagtggtggccccactggaagccgagttcaggagcggctaagcggtcgccggggaaagcaccggggcttcccagggtcccctccgagttcccactccgcacctccgagggcgtgaaaaccacgggagccgccccaccccgcgcgcccagccccgccccagcccagacaccgccccccgccagtcttccctgcggcgcccagggaggacgcgctccgcccccttccaatccggccaatgggcgcccgggcagcgcgcggtttgcctccgcctccgccagggaaacttggaggaggagaaaagtttgtacagagggtggaaaggcgagagcggagctccaagcccggcagcccgagaggaagatgaacagccccaggccagagcctctggcagagtggaccccgagccgcccccaggtagccaggagcggcctcagcggcagccgcaaactccagtagccgcccgtgctgcccgtggctggggcggagggcagccagagctggggaccaaggctccgcgccacctgcgcgcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatcatcctacaactcacattagagaacatcctggcttttgagcacttttcaaacaatcaagttgactcacgtgggtcctgaggcctgcagcacgtcggatgctaccccactatgacagaggattgtggtcacaacttgatggctgcgaagacctaccctccgtttttctactagataggaggatggtagaagtttggctgctgtcataacatccagagctttgtcgtatttggcacacagcagaggcccagatattagaaaggctctattccaataaactatgaggactgccttatggatgatttaagtgtctcactaaagcatgaaatgtgaatttttattgttgtacatacgatttaaggtatttaaagtattttcttctctgtgagaaggtttattgttaatacaaggtataataaaattatcgcaacccctctccttccagtataaccagctgaagttgcagatgttagatatttttcataaacaagttcgagtcaaagttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaataacccataattgaagtgtataatataaaaaattttaaaaatctaagcagcttattgtttctctgaaagtgtgtgtagttttactttcctaaggaattaccaagaatatcctttaaaatttaaaaggatggcaagttgcatcagaaagctttattttgagatgtaaaaagattcccaaacgtggttacattagccattcatgtatgtcagaagtgcagaattggggcacttaatggtcaccttgtaacagttttgtgtaactcccagtgatgctgtacacatatttgaagggtctttctcaaagaaatattaagcatgttttgttgctcagtgtttttgtgaattgcttggttgtaattaaattctgagcctgatattgatatggttttaagaagcagttgtaccaagtgaaattattttggagattataataaatatatacattcaa

SEQ ID NO: 169919 - DNA, 1774 bp, Homo sapiens
  Payload ID: 13451
  Gene Symbol: PTGES
  Gene Name: prostaglandin E synthase
  Uniprot ID: O14684
  ENST ID: ENST00000340607
  CDS Start-End: 36-494
tgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgtgtgttttctcctagacccgtgacctgagatgtgtgatttttagtcattaaatggaagtgtctgccagctgggcccagcacctcg

SEQ ID NO: 169920 - DNA, 1614 bp, Homo sapiens
  Payload ID: 13452
  Gene Symbol: PTGES2
  Gene Name: prostaglandin E synthase 2
  ENST ID: ENST00000277462
  CDS Start-End: 603-1163
ctctcgggcgccgggcggggccatcccggggctgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcggctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgggacggcagatatgaaatgcctggcacagtgcttggggtctagtatgtagcttccagaacccaccctgcccctctacctgggaggccaaatggcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcgttcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatgg

SEQ ID NO: 169921 - DNA, 2331 bp, Homo sapiens
  Payload ID: 13452
  Gene Symbol: PTGES2
  Gene Name: prostaglandin E synthase 2
  Uniprot ID: Q9H7Z7
  ENST ID: ENST00000338961
  CDS Start-End: 746-1879
ctctcgggcgccgggcggggccatcccggggctgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgaggagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcgttcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatgga

SEQ ID NO: 169922 - DNA, 803 bp, Homo sapiens
  Payload ID: 13452
  Gene Symbol: PTGES2
  Gene Name: prostaglandin E synthase 2
  ENST ID: ENST00000449878
  CDS Start-End: 8-803
agcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccagg

SEQ ID NO: 169923 - DNA, 1344 bp, Homo sapiens
  Payload ID: 13452
  Gene Symbol: PTGES2
  Gene Name: prostaglandin E synthase 2
  ENST ID: ENST00000617202
  CDS Start-End: 333-893
agagagaaccgcaacacctggtgccgggtcgggtcgtttccggggctttcagtggccggaagtcgcggcgcctgtactgactctaggaagggctggagttgttttgaatgggcgcccgtaagagaggtgggcaactctccctgtccagccgcctgcagctgaccctgtaccagtacaagacgtgtcccttctgcagcaagaaaggtgcccatcctggtggcccaggaaggagaaagctcgcaacaactaaatgactcctctgtcatcatcagcgccctcaagacctacctggtgtcgggcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaccgcctccaggacaacgtgcgcgaggacctctatgaggctgctgacaagtgggtggctgctgtgggcaaggaccggcccttcatggggggccagaagccgaatctcgctgatttggcggtgtatggcgtgctgcgtgtgatggaggggctggatgcgttcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatgg

SEQ ID NO: 169924 - DNA, 1920 bp, Homo sapiens
  Payload ID: 13453
  Gene Symbol: PTGES3
  Gene Name: prostaglandin E synthase 3 (cytosolic)
  Uniprot ID: Q15185
  ENST ID: ENST00000262033
  CDS Start-End: 302-784
ccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttg

SEQ ID NO: 169925 - DNA, 957 bp, Homo sapiens
  Payload ID: 13453
  Gene Symbol: PTGES3
  Gene Name: prostaglandin E synthase 3 (cytosolic)
  ENST ID: ENST00000456859
  CDS Start-End: 377-751
tagaaagccgcgccggagcccaaaaacaaggactgcgcacgcgcggcggcaaggcccgggcattttgctgcgtcaccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaa

SEQ ID NO: 169926 - DNA, 941 bp, Homo sapiens
  Payload ID: 13453
  Gene Symbol: PTGES3
  Gene Name: prostaglandin E synthase 3 (cytosolic)
  Uniprot ID: Q15185
  ENST ID: ENST00000436399
  CDS Start-End: 164-547
gaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacat

SEQ ID NO: 169927 - DNA, 1547 bp, Homo sapiens
  Payload ID: 13453
  Gene Symbol: PTGES3
  Gene Name: prostaglandin E synthase 3 (cytosolic)
  Uniprot ID: Q15185
  ENST ID: ENST00000414274
  CDS Start-End: 289-681
ggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataa

SEQ ID NO: 169928 - DNA, 1017 bp, Homo sapiens
  Payload ID: 13453
  Gene Symbol: PTGES3
  Gene Name: prostaglandin E synthase 3 (cytosolic)
  Uniprot ID: Q15185
  ENST ID: ENST00000448157
  CDS Start-End: 286-705
ctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgaggattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtct

SEQ ID NO: 169929 - DNA, 2077 bp, Homo sapiens
  Payload ID: 13453
  Gene Symbol: PTGES3
  Gene Name: prostaglandin E synthase 3 (cytosolic)
  ENST ID: ENST00000614328
  CDS Start-End: 447-941
gctgggaggccccgccctttccgtagatatctctagaaagccgcgccggagcccaaaaacaaggactgcgcacgcgcggcggcaaggcccgggcattttgctgcgtcaccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatactccattcagaagagagaagaggggagtgactttatgtctttggaaaagcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttg

SEQ ID NO: 169930 - DNA, 1781 bp, Homo sapiens
  Payload ID: 13454
  Gene Symbol: PTGES3L
  Gene Name: prostaglandin E synthase 3 (cytosolic)-like
  ENST ID: ENST00000409446
  CDS Start-End: 252-737
aggacaataatgttttattgagcgcctattgtgaatcagacactgagcagtaagcgtcggagaaacaggtgaatgataccggggaaaagtcattccctgtgtgtagcgtctagggcagcctttgccctggttccagcagatgggttgtctcttcatagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacgctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgttctctgtctgtttccttcttgtacttattcctcctggtggcaagcctcttctccctctagtaaccaagctggggtgcttcctcttgcccagatttgtgctctgatttcttacagctaattctgtcatctctagaaccagccacttcagcttcctgcacactctagaaatctctttatactttttttttttttttccgagatggagtcttgctctgtcgcccaggctggagtgcagtggtgcagtctctgttcactgcaacctccaccttctgggttcaagcaattctcctgcctcagcctcccaagtagatgggactacagatgtgcaccaccaggcccagctaatttttgtatttttagcagagatggggtttcaccatgttggccaggctggtctcgaactcctgacctcaagtaatccacccacctcagcctcccaaagtgctaggattacatgtatgagccaccacacccggccctctttatacttttaaaactgattgttactctagttaatgtctatgtttatttgtccaacagctattctatttgtccataaacttttttgagtgcctaatatgtacagttgactgtaacttaaacaaaataaatgcattgcctat

SEQ ID NO: 169931 - DNA, 1446 bp, Homo sapiens
  Payload ID: 13454
  Gene Symbol: PTGES3L
  Gene Name: prostaglandin E synthase 3 (cytosolic)-like
  ENST ID: ENST00000424284
  CDS Start-End: 1-386
ggcagcacgcccggaccttgtggtacgacaggcccagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgttctctgtctgtttccttcttgtacttattcctcctggtggcaagcctcttctccctctagtaaccaagctggggtgcttcctcttgcccagatttgtgctctgatttcttacagctaattctgtcatctctagaaccagccacttcagcttcctgcacactctagaaatctctttatactttttttttttttttccgagatggagtcttgctctgtcgcccaggctggagtgcagtggtgcagtctctgttcactgcaacctccaccttctgggttcaagcaattctcctgcctcagcctcccaagtagatgggactacagatgtgcaccaccaggcccagctaatttttgtatttttagcagagatggggtttcaccatgttggccaggctggtctcgaactcctgacctcaagtaatccacccacctcagcctcccaaagtgctaggattacatgtatgagccaccacacccggccctctttatacttttaaaactgattgttactctagttaatgtctatgtttatttgtccaacagctattctatttgtccataaacttttttgagtgcctaatatgtacagttgactgtaacttaaacaaaataaatgcattgcctatagactttgctcttgaa

SEQ ID NO: 169932 - DNA, 557 bp, Homo sapiens
  Payload ID: 13454
  Gene Symbol: PTGES3L
  Gene Name: prostaglandin E synthase 3 (cytosolic)-like
  ENST ID: ENST00000451885
  CDS Start-End: 1-399
aaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaag

SEQ ID NO: 169933 - DNA, 855 bp, Homo sapiens
  Payload ID: 13454
  Gene Symbol: PTGES3L
  Gene Name: prostaglandin E synthase 3 (cytosolic)-like
  ENST ID: ENST00000591916
  CDS Start-End: 1-494
gccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgc

SEQ ID NO: 169934 - DNA, 4450 bp, Homo sapiens
  Payload ID: 13455
  Gene Symbol: PTGFR
  Gene Name: prostaglandin F receptor (FP)
  Uniprot ID: P43088
  ENST ID: ENST00000370756
  CDS Start-End: 238-1131
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagtggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctgggatacagaataattttgaatgggaaagagaaatataaagtatatgaagagcaaagtgatttcttacataggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaacaaaccgaagctacatgccaatgataggtgcaaagaatattggcaaaaggtgctttaccttgagccattatttgtgtcagagaacaaaagaaacagaatcaatatataaaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagagttctttgctttcattaacttggattcatttaaaaattaatcttccctgttaggctgatttcagattctctaggaaatctgtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaattaaaaaaaaaaaaaggaatgtgttttcattgttttaagtttttcttctgagtaaaacaaaattatagaaaacaaatgcaacaatgtgcacatctgacttaagagtttcatttctgttattatatgtgttgcatgtagcttggcgatttactgtgtaatgaataatagactggaacatctaccaataactttcacataaatgttcaaaatagaagtgtattttttcaggtttctggaaataaatagtaaaataaatggcacaaatagtttcaataaatttaccaatttgagtgttttcagctctatttcaaaactcataactaatcttcagaattactgaatttccttttgaactgggtaaggcattatccaagcaacttcacatactatttaaacatgatttctcggtaattatatattctgggcaaataacataaacatgtcaggatttttacaggtgttagtgaatttttctaaaaagatgagacaaaagcaaaaatatcacacataggtttttatgactatgaatacaaagataatgctgattcacaattagctatgggtaagtccaaaacatcagaccttttactgatgggttaactaggtgaaagaaatgggcccttatttttttttttccctagaggcagaaagttacttctaatgatctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtt

SEQ ID NO: 169935 - DNA, 4379 bp, Homo sapiens
  Payload ID: 13455
  Gene Symbol: PTGFR
  Gene Name: prostaglandin F receptor (FP)
  Uniprot ID: P43088
  ENST ID: ENST00000370757
  CDS Start-End: 238-1317
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagtggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaacaaaccgaagctacatgccaatgataggtgcaaagaatattggcaaaaggtgctttaccttgagccattatttgtgtcagagaacaaaagaaacagaatcaatatataaaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagagttctttgctttcattaacttggattcatttaaaaattaatcttccctgttaggctgatttcagattctctaggaaatctgtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaattaaaaaaaaaaaaaggaatgtgttttcattgttttaagtttttcttctgagtaaaacaaaattatagaaaacaaatgcaacaatgtgcacatctgacttaagagtttcatttctgttattatatgtgttgcatgtagcttggcgatttactgtgtaatgaataatagactggaacatctaccaataactttcacataaatgttcaaaatagaagtgtattttttcaggtttctggaaataaatagtaaaataaatggcacaaatagtttcaataaatttaccaatttgagtgttttcagctctatttcaaaactcataactaatcttcagaattactgaatttccttttgaactgggtaaggcattatccaagcaacttcacatactatttaaacatgatttctcggtaattatatattctgggcaaataacataaacatgtcaggatttttacaggtgttagtgaatttttctaaaaagatgagacaaaagcaaaaatatcacacataggtttttatgactatgaatacaaagataatgctgattcacaattagctatgggtaagtccaaaacatcagaccttttactgatgggttaactaggtgaaagaaatgggcccttatttttttttttccctagaggcagaaagttacttctaatgatctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtt

SEQ ID NO: 169936 - DNA, 4337 bp, Homo sapiens
  Payload ID: 13455
  Gene Symbol: PTGFR
  Gene Name: prostaglandin F receptor (FP)
  Uniprot ID: P43088
  ENST ID: ENST00000370758
  CDS Start-End: 196-1275
catgaggaaatgtagctgtatgcctggagggatctacagccagaccagccaactcagcctggttaagaacacctgttgaagaactagtgcaggcgtttggaggacataggacactctggccatatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagtggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcatatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaaactctaccatggataatgcaaacaaaccgaagctacatgccaatgataggtgcaaagaatattggcaaaaggtgctttaccttgagccattatttgtgtcagagaacaaaagaaacagaatcaatatataaaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagactttttctttgcttgtttgtgtaattcaaccaaaagaatttcaatacccattcaaattgtcctaggtctatcagaaattagggaaggtagtcctgctttataataggaaaatgtatttctgtataagagttctttgctttcattaacttggattcatttaaaaattaatcttccctgttaggctgatttcagattctctaggaaatctgtgtaagtaaccagaagacctttcagatggtttatttgctttcagcagagaatttatttcatacagttacttaagagtgttgatgtcttgtgaacagagatataaggaaccattctccatccttccttatcatgctgggtacaatgcttctatgaatatttccatgtattttgactggggagaggcatggagaagaaactctcattcaggggctccaggatccttctccttgaggcttctaaataaatggcagaattcttgctgtattgccatgatgtcaccctggccatgtgtactgacttgaggagatcttgcaacatggccatgtgcaaggctttaaggagtgagagagatgtgtacatatcttaggagggttatctatgttatctgagtatatgtttgggtaaccaaattggtcttaaaaatgatgttaacccaagaagtagacatcaaaaattaaaaaaaaaaaaaggaatgtgttttcattgttttaagtttttcttctgagtaaaacaaaattatagaaaacaaatgcaacaatgtgcacatctgacttaagagtttcatttctgttattatatgtgttgcatgtagcttggcgatttactgtgtaatgaataatagactggaacatctaccaataactttcacataaatgttcaaaatagaagtgtattttttcaggtttctggaaataaatagtaaaataaatggcacaaatagtttcaataaatttaccaatttgagtgttttcagctctatttcaaaactcataactaatcttcagaattactgaatttccttttgaactgggtaaggcattatccaagcaacttcacatactatttaaacatgatttctcggtaattatatattctgggcaaataacataaacatgtcaggatttttacaggtgttagtgaatttttctaaaaagatgagacaaaagcaaaaatatcacacataggtttttatgactatgaatacaaagataatgctgattcacaattagctatgggtaagtccaaaacatcagaccttttactgatgggttaactaggtgaaagaaatgggcccttatttttttttttccctagaggcagaaagttacttctaatgatctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtt

SEQ ID NO: 169937 - DNA, 1852 bp, Homo sapiens
  Payload ID: 13455
  Gene Symbol: PTGFR
  Gene Name: prostaglandin F receptor (FP)
  ENST ID: ENST00000497923
  CDS Start-End: 238-1131
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagtggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctgggatacagaataattttgaatgggaaagagaaatataaagtatatgaagagcaaagtgatttcttacatagcgataagacactcaacgagaaatgacagaaaaacaaggtgtggatggagaggcaacatgaaagtggatcaaacaacttatacatgggtgctggctcagacgtgacacctgaggctccagaactggaagtttatgccgtcaagttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaattaagacatgtttggcaatatttcagttagttaaatacctgtagcctaactggaaaattcaggcttcatcatgtagtttgaagatactattgtcagattcaggttttgaaatttgtcaaataaacaggataactgtacatttttcacttgtttttgccaatgggaggtagacacaataaaataatgccatgggagtcacactgaaagcaattttgagcttatctgtcttatttatgctttgagtgaatcatctgttgaggtctaatgcctttacttggcctatt

SEQ ID NO: 169938 - DNA, 6178 bp, Homo sapiens
  Payload ID: 13456
  Gene Symbol: PTGFRN
  Gene Name: prostaglandin F2 receptor inhibitor
  Uniprot ID: Q9P2B2
  ENST ID: ENST00000393203
  CDS Start-End: 148-2787
gatttatcggctcgcgaggagagcggagcaggcgcgcggcccaggcggaggagcgccgactctggagcagccggagctggaagaggaggaggaggagaggcggcggggaaggaggaggagggggagagtcgctcccgccgggcgagcatggggcgcctggcctcgaggccgctgctgctggcgctcctgtcgttggctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattgaa

SEQ ID NO: 169939 - DNA, 2107 bp, Homo sapiens
  Payload ID: 13457
  Gene Symbol: PTGIR
  Gene Name: prostaglandin I2 (prostacyclin) receptor (IP)
  Uniprot ID: P43119
  ENST ID: ENST00000291294
  CDS Start-End: 135-1295
acggagggaggagggaaggagaagctgacacacagaccgacacaggcagcgagagacacgaggagcaaagcaagtgaaggcacagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtgaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctcagggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctggggccgatcagctgctgtttctcctgcggcagggcagtcgctgctggctctgggaagagagtgagggacagaggaaacgtttatcctggagtgcagaaagaatggttctctcaaaataaccagtggcctggccgacctgctctggccctggattccccatccatctcattgtctaaatatttagaaggcggagaagttcccagaggcttctgtacagtcaggtctgctctggtctgggtgctggctccaatctgcgtccacttaggaggcccaactgcccaccccaagtccccaggggatggccctccccctctaccaagccactccaagagccagcccctttctgctccacaaaaaccacagttattggaaaagctccctgccttcccttgccgctggtcccccaccaggcttgggagccctggcatcccaaaggggcaacgggaggaaggggaggctgctgcattgtgggtgatgacgtaggacatgtgcttggtacaaaaagggcctgagacattccacctagcttgactggctgcaagatgagaactgggggggtgcaggtggtggggagacagatggagaagctggcagatgaagggtgggggctgcggatcccagggactgccccagaacacaaacctaagtcctgtgcctgtccccagggtcctgaataaataaaagcctccttgcagagcctga

SEQ ID NO: 169940 - DNA, 1009 bp, Homo sapiens
  Payload ID: 13457
  Gene Symbol: PTGIR
  Gene Name: prostaglandin I2 (prostacyclin) receptor (IP)
  ENST ID: ENST00000596260
  CDS Start-End: 54-944
acagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtgaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgcatgtagaaaggccgaggcaggaccggatgcggtggctcacacctgtaatcccagcactttgggaggccgaggccggcggatcatttgaggtcaggagttcgagaccagtctggccaacatgatgaaaccctgtctctactaaaaatacaacaaataaataaataaaaagtagccggacgtagtggca

SEQ ID NO: 169941 - DNA, 699 bp, Homo sapiens
  Payload ID: 13457
  Gene Symbol: PTGIR
  Gene Name: prostaglandin I2 (prostacyclin) receptor (IP)
  ENST ID: ENST00000594275
  CDS Start-End: 155-586
cagcgagagacacgaggagcaaagcaagtgaaggcacagacgcacgggacaggagagcctgggcaagactggagagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctcagggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctgggg

SEQ ID NO: 169942 - DNA, 775 bp, Homo sapiens
  Payload ID: 13457
  Gene Symbol: PTGIR
  Gene Name: prostaglandin I2 (prostacyclin) receptor (IP)
  ENST ID: ENST00000597185
  CDS Start-End: 315-662
cagcgagagacacgaggagcaaagcaagtgaaggcacagacgcacgggacaggagagcctgggcaagactggagaggtgcggtgaggggctggggatgcagcaacacagagcaggagcagatacatttgttacttagtctttatcttatctccttcccctctgacatgtcacccctacctcatccctggtaagcaagtgggaggagggagccagggtggggaggctgaggactcctgggtgctccttgacgccctcaccctgccctcagatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctcagggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctgggg

SEQ ID NO: 169943 - DNA, 724 bp, Homo sapiens
  Payload ID: 13457
  Gene Symbol: PTGIR
  Gene Name: prostaglandin I2 (prostacyclin) receptor (IP)
  ENST ID: ENST00000598865
  CDS Start-End: 87-611
cagcgagagacacgaggagcaaagcaagtgaaggcacagacgcacgggacaggagagcctgggcaagactggagagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctcagggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctgggg

SEQ ID NO: 169944 - DNA, 5579 bp, Homo sapiens
  Payload ID: 13458
  Gene Symbol: PTGIS
  Gene Name: prostaglandin I2 (prostacyclin) synthase
  Uniprot ID: Q16647
  ENST ID: ENST00000244043
  CDS Start-End: 31-1533
gccagccccgccagccccgccagccccgcgatggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtgacaggcaccagatgggatgggctttctcagtgtcagcactcaggtagggagctaaggaagacacagcccagacaagatggctggaaggagccagccaggactccttagactgatcaagccaaaaaagaaggtgccgatttcatgcattctagtgcagaagccccaactgtgatcacgatccagtctgcagacgtgttttgtttggacttcacttaaaaaaatgccttagttgttatcatctttgggagagttcattcaaaatgtccagcttctcttgaaaacttggtatatctggccacactgggctcacattcccaagggtaactcttggccagagctgagtggcagccgcctcccttatgcaggacatgtgctctcggcttcaccagggttctgaccgggtctgcttctgcattcacagcgcctcctggacctgaaggcatctgagtgtgagaccctgttctaactcttagaagtgacattgtaagaggtggtggggaccagctaattggtccaacccagcctgagtgcaccaccctttgaacaaatgtatcagtgatgaaaatttgcctttgccccggcttgcctgtaatcccagcactttgggaggccgaggtgggcggatcacttgaggtcgggagttcaagaccagcctggccaacatggcgaaaccccgtctctactaaacataaaaaaattagtcaggtgtggcggtgcgtgcctgtaatcccagctattcaggaggctgaggcaccagaattgcttgaacccaggaggtggaggttgcagtgaactgagactgcgccacggcactccagcctgggcgacagagcaagactctgtctcaataaataaataattaattaaaataaaaaacagcttaaagagaaaaatggcctgcaaaccttttttatgatgctatttttattaatataaagtcctgtttattgagaccctttaaatgcctgcgagagaccctacagacagtatgtctactcctcacagcatctctatgaagagaaggagggttgtgcccacttcatagatgagaaaactgagaggtgaggtgacttgcctggggccacatagctcataagctgtagaactctgcaggcagatttactgtcccaggagcaaatgctggatgagcaactcctgttctttgggctcaaggggactggtgatgggacaattcttctcgacttcaggagctgacagagccagaggcacctaaacttgggtacatcttgtaagacacataatgaggtccctctagctttagctggagggagataaaagaaccccagacctctgaatgtcccagaggctagtctcttctcagagcagcactggggtttgggggcttccctgggcctcagcctccaggcacccccaggattcccagagagacgctgtgattggcaggaggcaggatatccccagggaaacccatcttcacgcctgggtgacccccactgccgcctccttcttaactctgcaggaaatcagagctggcagcctccagtgggaggacagagccggtttccgtggcaaccctcagctgcctcatcgtggctgggaagggaaggaagcaagccggcagaaatagctatggaaggtcttgcgcaggctgcaaccctggtgtgctgggcgaaaacccttatgactccccccttccaaatcaggctgggttgtcactgagactagattctcacctgccttcaaagaagggccaattccctttaaaggtcgcacctccttggaaccacagtcattagtgaattacactcaaggaaaagatgtgctcccaccaggcagctccagctgttacctgagatactgaagtgcagctcaggagacgattatttaaacctgcccttgttttaatcgttatttttctctttaaaaaaaatagaagctataaagaaaagagggagagatgagtgggttagctacctgctatgcgctagttaggaagttacctggatgccattgtatttcttcatcccttgcttaagaatcaaaattactggacatatgttaggaatactctttctttctttctttctttttaagctcagtggcaagaatgaaatactctttttttttttttttttttgagatggagtctcgctctgctgcccaggctagagtgcagtggcgtgatctcggctcactgcaagctctgcctcccgtgttcacaccattctcctgcctcagcctcctgagtagctgggactacaggcacccgccaccacacccggctaatttttggatttttagtagagatgggatttcaccgtattagccaggatggtcttgatctcctgagctcgtgatctgcccgcctcggcctcccaaagtgctgggattacaggtgtgagccaccgcgcccagccaagaataaaatactcttaagttgatctaatgaagtgtttccttaccattgtgattattgttactattatttgctatattttaatattgttgtttaccaaatattctcctttaaacagactcgctttttaaacttttttttttttttttgagacggagtttcacgcttattgcccaggctggagtgcaatggcacgatctcagctcaccacaacctccacctcctgggtttaagcaatgcttctgcctcagcttcccaagtagctgagattacaggcgcacaccaccacgcccaactgatttttgtatttttagtagagacggggtttccccatgttggtcaggctggtctcgaactcctgacctcgtgatttgcctgcctgggcctcccaaagtgctaggattacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgttacaaaacgagataagcaagtgttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttgatgattaaaaagaataaacacagtgtttcctgagtagcagtgattgttatgccttgctattttaataaagattctattttcgtataacattgtcaagtggaaacatgctgaaatctattaaaccatctttgtttgtggaa

SEQ ID NO: 169945 - DNA, 1223 bp, Homo sapiens
  Payload ID: 13459
  Gene Symbol: PTGR1
  Gene Name: prostaglandin reductase 1
  Uniprot ID: Q14914
  ENST ID: ENST00000309195
  CDS Start-End: 80-1069
gttccttggagagcttggagccgcgcgccggagggaataggaaagcttggttacaacccgggacacccggagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaa

SEQ ID NO: 169946 - DNA, 2298 bp, Homo sapiens
  Payload ID: 13459
  Gene Symbol: PTGR1
  Gene Name: prostaglandin reductase 1
  ENST ID: ENST00000374324
  CDS Start-End: 11-232
gagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaccagttattataataccattggtagaaatcgtctatggatctttactggaatttcagtgaccttacagatttatttagaggaaactgacatctttacaatttctctctccaaacacaagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcaggtaactcaggtctctatataagaccccttaaaaaaatctgaaaatgtaaattagttcccattagtaggctgtgccttgtaggagaaagagaaatgaagaccctttctcactaacatgaacccttccttcccacactcccagataaaggttaaacacatgttaaaagaaccttggcttaaaggggagacagattattagactgtcctgccatttatatttcctgaataggacctgcctcttcaggggccagaggtaatgaagggtgctcttttctctgtctatttgtacctcctctgagatcattgtgttattaaactttactatgcatcttatttagaaattgcttaatcgctctgggcacggtggctcacgcctgtaatcccagcactttgggaggccgaggcaggcagatcacgaggtcaggagatcgagaccatcctggctaacacggtgaagccctgtccctactaaaaatacaaaacaattagccgggcatggtggtgagcacctgtagtcccagctagtcgggaggctgaggcaggagaatggcatgaacctgggaggcggagcttgcagtgagccaagatcgcggcactgcactccagcctgggcaacagagcgagactctgtctcaaaaaaaaaaaaaagaaagaaaaagagattgcttaatcactgccttatgacatttcgcactatgatccgacacctattatttcttcttaggtgtactttgtaatcttttttacatgtactgtgtaagtggatcttgccccaccttgacttcaagttcatggaggacaggacttccatctcttattttcaaggtttccaatgatgtacctgataaatttgttgctaggatgagaacagtatatcattgagaatattaaattaagttttaaaatttgttgttgctttgatacagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggt

SEQ ID NO: 169947 - DNA, 1407 bp, Homo sapiens
  Payload ID: 13459
  Gene Symbol: PTGR1
  Gene Name: prostaglandin reductase 1
  Uniprot ID: Q14914
  ENST ID: ENST00000407693
  CDS Start-End: 264-1253
atgcacacatacgcgcgcgcacatgcacataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaa

SEQ ID NO: 169948 - DNA, 461 bp, Homo sapiens
  Payload ID: 13459
  Gene Symbol: PTGR1
  Gene Name: prostaglandin reductase 1
  ENST ID: ENST00000422125
  CDS Start-End: 104-461
accctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtg

SEQ ID NO: 169949 - DNA, 1094 bp, Homo sapiens
  Payload ID: 13459
  Gene Symbol: PTGR1
  Gene Name: prostaglandin reductase 1
  ENST ID: ENST00000466771
  CDS Start-End: 1-357
caaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccatcatggcacacgtttacctatgtaacaaacctgcacattccacacaattatcccggaactgaaaataaaataaaattaaattaaaaaaaaaa

SEQ ID NO: 169950 - DNA, 1220 bp, Homo sapiens
  Payload ID: 13459
  Gene Symbol: PTGR1
  Gene Name: prostaglandin reductase 1
  Uniprot ID: Q14914
  ENST ID: ENST00000538962
  CDS Start-End: 264-1169
atgcacacatacgcgcgcgcacatgcacataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagatcaaaagagaaaatgaagaagattgaagcttcaaagcagaaaaatgaagggaatatgtatcattcaccattacctta

SEQ ID NO: 169951 - DNA, 2559 bp, Homo sapiens
  Payload ID: 13460
  Gene Symbol: PTGR2
  Gene Name: prostaglandin reductase 2
  Uniprot ID: Q8N8N7
  ENST ID: ENST00000267568
  CDS Start-End: 222-1277
agtgacgcgcgagcggctcccgcgactgtggctcccgaagctgcttcgggccccagcggtgaggaagaagactctcaaccagggtgacttctaggcgtcctcccggagctaccggggacactggcgttattgcccgcaacactgagatagggaatgctcgagaaacagaagcaggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctcaaaagtttgttttattaattgtactcaaccctcgcagaacagtaaaactgaagattattgtt

SEQ ID NO: 169952 - DNA, 1351 bp, Homo sapiens
  Payload ID: 13460
  Gene Symbol: PTGR2
  Gene Name: prostaglandin reductase 2
  ENST ID: ENST00000553813
  CDS Start-End: 296-949
ggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaaga

SEQ ID NO: 169953 - DNA, 2543 bp, Homo sapiens
  Payload ID: 13460
  Gene Symbol: PTGR2
  Gene Name: prostaglandin reductase 2
  Uniprot ID: Q8N8N7
  ENST ID: ENST00000555228
  CDS Start-End: 209-1264
ctgcggtcagagggccgaggcctgggggcgagctggggtcgtgcagtacagcctctttccggcaaatcacgcgagatttcgttcacccgggctccacagggtcagtgacgcgcgagcggctcccgcgactgtggctcccgaagctgcttcgggccccagcggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctcaaaagtttgttttattaattgtactcaaccctcgcagaacagtaaaactgaagattatt

SEQ ID NO: 169954 - DNA, 3851 bp, Homo sapiens
  Payload ID: 13460
  Gene Symbol: PTGR2
  Gene Name: prostaglandin reductase 2
  Uniprot ID: Q8N8N7
  ENST ID: ENST00000555661
  CDS Start-End: 146-1201
gcggtcagagggccgaggcctgggggcgagctggggtcgtgcagtacagcctctttccggcaaatcacgcgagatttcgttcacccgggctccacagggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctcaaaagtttgttttattaattgtactcaaccctcgcagaacagtaaaactgaagattattgtttctgaatgttttggcttatgattgtctacacactgccaatatacttttgtatgcaacatttgtaataagtagattcaaactgtgttggtaatcagcctccccagttttcgtgagtggcccttttttgttacttttcctggaccatttcatcgcctgagggggtttcacttttctctgtatgttgctaactcccaaatctccatctgtatttctgacctctttcttgagcactggacctttacctccaagtaaatatcctcaactctggattgcatcttatactctgcttttttcttttcttttcttttttgagatggagtcttgctcagtcgcccggcgtgcagcggcacgatctcggctcactgcaacctccgcctcccgggttcaagcgattctcctgcctcagcctcccgagtagctaggattacaggcgcgtgccaccacgcccggctaatttttgtgtttttagtagagacgggttttcacggcgttacccaggatggtctcgatctcctgacctcgtgatccgcccaccttagcctcccaaagtgctgggattaaaggcgtgagccacggagtccggcctactctgcttttctaaagtggaattatcttcctctgaaatgtttctcctttattttaaatcaccattagtaatttgtgtacccaaacctgtcatcaaggcttatctttaaccttgaaaatgcctttttaaagagaactcctttaattcccacggttgagtctctcattcttccgcacgcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagtcccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctc

SEQ ID NO: 169955 - DNA, 2328 bp, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENST ID: ENST00000223423
  CDS Start-End: 6-1694
gcgccatgagccggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgt

SEQ ID NO: 169956 - DNA, 4964 bp, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENST ID: ENST00000362012
  CDS Start-End: 6-1805
gcgccatgagccggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcca

SEQ ID NO: 169957 - DNA, 4987 bp, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENST ID: ENST00000373698
  CDS Start-End: 357-1829
agcttgtggctcttctgcctgccgaggcagagctctagggccatggcgggaggccttccggctccacctcagacagctgttgagggcctggaagatgagggactccttttggtcaggctggagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcc

SEQ ID NO: 169958 - DNA, 468 bp, Homo sapiens
  Payload ID: 13461
  Gene Symbol: PTGS1
  Gene Name: prostaglandin-endoperoxide synthase 1 (prostaglandin G/H synthase and cyclooxygenase)
  ENST ID: ENST00000426608
  CDS Start-End: 1-468
agtctcttgctctggttcttgctgttcctgctcctgctcccgccgctccccgtcctgctcgcggacccaggggcgcccacgccagctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccg

SEQ ID NO: 169959 - DNA, 5375 bp, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENST ID: ENST00000540753
  CDS Start-End: 604-2217
agtagtgagtttctcatctaggaaaccatcagcaggccaggctggactgccccatttctagccccctttcttctctgcagactgccctgtttctagccccttttcttctctacccttttctgtagagtgcgttagacccattttacagaaggggactctgagaccctttcttctctgcggggcagggtatgtggttcagacgagccgcttccatccccagttctgtccctaagccctgggtgacctcagcattgagcatcgtctctgagcctcagtttcctgtctatatctagtgccaccaggcatcagaaacggagtctcttgctctggttcttgctgttcctgctcctgctcccgccgctccccgtcctgctcgcggacccaggggcgcccacgccaggggcctctttgggaggaagccgcaggcaccaagggaaatgagttccctttctccagcctctaaccgtctgggaacccatcctgattcccattgccagtggagaaggtctcccctggtgaagacttcgggagaacatgggagatggaaatacatttaggagccgggatgcttcatctggggtttaagagatccccattgagcaaatgaggaaaccgaggctcatgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcc

SEQ ID NO: 169960 - DNA, 5051 bp, Homo sapiens
  Payload ID: 13461
  Gene Symbol: PTGS1
  Gene Name: prostaglandin-endoperoxide synthase 1 (prostaglandin G/H synthase and cyclooxygenase)
  Uniprot ID: P23219
  ENST ID: ENST00000619306
  CDS Start-End: 1-1893
atgagccgtgagtgcgaccccggtgcccggtggggaattttcttggcctcctggtggagccttgaatgccagctcagcccctcatctctctcctctgcagggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcc

SEQ ID NO: 169961 - DNA, 4894 bp, Homo sapiens
  Payload ID: 13461
  Gene Symbol: PTGS1
  Gene Name: prostaglandin-endoperoxide synthase 1 (prostaglandin G/H synthase and cyclooxygenase)
  ENST ID: ENST00000614910
  CDS Start-End: 81-1736
atgggctggagctccgggcagtgtgcgaggcgcacgcacaggagcctgcactctgcgtcccgcaccccagcagccgcgccatgagccggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcc

SEQ ID NO: 169962 - DNA, 4514 bp, Homo sapiens
  Payload ID: 13462
  Gene Symbol: PTGS2
  Gene Name: prostaglandin-endoperoxide synthase 2 (prostaglandin G/H synthase and cyclooxygenase)
  Uniprot ID: P35354
  ENST ID: ENST00000367468
  CDS Start-End: 138-1952
gaccaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagtagaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataatgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaattgacagatcttttctgaagataaactttgattgtttctata

SEQ ID NO: 169963 - DNA, 1705 bp, Homo sapiens
  Payload ID: 13462
  Gene Symbol: PTGS2
  Gene Name: prostaglandin-endoperoxide synthase 2 (prostaglandin G/H synthase and cyclooxygenase)
  ENST ID: ENST00000559627
  CDS Start-End: 1-492
atgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtag

SEQ ID NO: 169964 - DNA, 2506 bp, Homo sapiens
  Payload ID: 13463
  Gene Symbol: PBOV1
  Gene Name: prostate and breast cancer overexpressed 1
  Uniprot ID: Q9GZY1
  ENST ID: ENST00000527246
  CDS Start-End: 97-504
gaccttaaatatatcgaggtggctaattgatgtataataatttacaaaattattcttctatgctacagagctacaattcaatttacagtagtaaatatgagggccttcttaaggaaccagaaatatgaggatatgcacaatattattcacattttacagatcagaaaattgaggcacagattaagtaacttcccaaggctaccaggcattctagctccagaaactgtgctcttaccattctgctacaaggtatttcgaaaaaaagaaaaagtaaaaagaagtcaaaaggcaacagagttcattgattattccatagaacagtcacaccatgcaattctcacacccttgcagacacacttgaccatgaaaggttcctcaatgaaatgttcctcattatcttcagaagccatattattcacattgactttgcagttaactcagaccctaggtctggaatgctgtcttctctacttatccaaaactatacatccacagatcatataaactctcagccctgctgcaaagcctttccagaaaaataaaaatggttgaaaaggcaattctgctaccaatgactgtttaagcccagccaagtaactgaaccattccaacttcaatttacttatgaaaagaatttgatgatgtaggaggttatttcaattctaaaatacaaacccatgttgatctttctcaatcttgaactcatagattattatctattatctcaatttagtttgttatttatcctagtgggccattaaaaactaccacatgtgtttctgtctctccattagtcaataactaaactaacgagcaattagtaagccatgtgccagatgctccgctaggcaccagagggataaaaacaatacttatagtataccactaattttcgcttagtaactagtgaaatgttcaagtcatgcctgagtcaagagttgaggagacattacaatgtgtaatggaaaccaaggaaagtgaaactttggataagtggggactagtgtatttatatatttaattgatttctgactctatcattggcctccaaacacagattgtgtttttctttggttttgttttcttcactatgggatcttctgtgcccagcacagtgcctgacacatagaaaacaatcaaatatttgctgaataaatgattaaaaaatcagagaactttcccattctgtttggatctatagaacatccagagtaagtgatgagggcctctgcatttatatgcgcttaaattaagattatgtgagaaaagtttaaagacacttagtagagtgattttgaaatatagtaaacacttggaaatggtggtgctttaaaaagatattaatagataatatgaaaatctccatctcaaaaataatgcataaactatttaaaggaaaatcacatctccaggctttcaatgtttgttcattactttttcatatatttttaccatctgctgaaggcagtcatatcaaagggtaaagaaagatgggaggaaaactcagtaagaattatattagtctgtttgcaaagtagaaaaagattctcatcactcaaccttatgagcaggaagagggaaggctgtttgagaaccatttacttagcagaaccacatattttagacacttccctgcattaactgcacaaacaatatgtttgcaaacttgttagatcaacctccaacaacgacacattcaggagttaaatatttttcatcaaacattggatttttccttaacgctagagattgctacaaatcttctgaagggtctcaatggcttcaggctaagaagagatttctccctgttataagcagcaagacaaattagccatttcactctcaaacttcactaatgatcacattctttccaaaaggaactctagaagaccaaatgccccgagttaagaacatcaaaactaaccatctgaagaaacttcccaagtgtaagactctgccattaaaacattaccgagaggggactcaaacagtctttcttcctttgtcgtgtttcttgctcccagaccaaggcactgacgacagtactgatacataatttaaaagcacactcccttccactttgtaataccagaactctaattggacaccctgaagcttaggactaccagccatacaaatagtaaactctgtccacgattcactcatctgtgtattttctatagatgtttactaggcgtttgttatataaaaataccccggccaggcacggtggctcacgcctgtaatcccagcactttgggaggtgggtggatcacctgaggtcgggagttcgagaccagcctgaccagcatggtggaacccccatctctactaaaaacacaaaaaattagccgggcgtggtggcacatgcctgtaatcccagctactcaggaggctgaggcggagaattgcttgaacccggaaggtggaggttgcggtgagctgagattgcactattgcactccagcctgggcaacaggagtaaaactcccccccacccaaaaaa

SEQ ID NO: 169965 - DNA, 1527 bp, Homo sapiens
  Payload ID: 13464
  Gene Symbol: PATE1
  Gene Name: prostate and testis expressed 1
  Uniprot ID: Q8WXA2
  ENST ID: ENST00000305738
  CDS Start-End: 13-393
cctctttccaaaatggacaagtccctcttgctggaactccccatcctgctctgctgctttagggcattatctggatcactttcaatgagaaatgatgcagtcaatgaaatagttgctgtgaaaaacaattttcctgtgatagaaattgttcagtgtaggatgtgccacctccagttcccaggagaaaagtgctccagaggaagaggaatatgcacagcaacaacagaagaggcctgcatggttggaaggatgttcaaaagggatggtaatccctggttaaccttcatgggctgcctaaagaactgtgctgatgtgaaaggcataaggtggagtgtctatttggtgaacttcaggtgctgcaggagccatgacctgtgcaatgaagacctttagaagttaatggttcttctgtgactccaatttctgggtgaggttgttgcctcagcctcttcacaatgactttctaaaaaaaatcacacacacacacacacacactacagaagaggattgcaaacacatggctccatcttctgcacacgaaaggaaagtccctctccttttctacagtctctgtcacgccccttaaaataagtaaataaataaccttgagagaaagaacaagatcaatatatcctgcaggttgctacaaacccttgtgctttcactgtatagccagttcattcagaaaaggaggaaagggtagtttaatttcaaaaaagaatcccttcctctttcctctgctgctttccttccttctgtggcagggtattttaatatatttttcaaatttttttcctttctgtgttatccttcttatcccactccaaagaaagcacataactgtggcctgaagggatggggagtagcaacataaaaagaagtggctcaagtcttcttggagtttgttcatgaatgctgatcccagggtgaggagaagattgggacatagaaaggaaactgcatcagaaacatgaacagagaaagattgtctgccttctagaatcagatctgtttggggctgggggttggagaataaaagcaggagaagtctatgggattctagaaatagtacctgcatccagcttccctgccaaactcacaaggagacatcaacctctagacagggaacagcttcaggatacttccaggagacagagccaccagcagcaaaacaaatattcccatgcctggagcatggcatagaggaagctgagaaatgtggggtctgaggaagccatttgagtctggccactagacatctcatcagccacttgtgtgaagagatgccccatgaccccagatgcctctcccacccttacctccatctcacacacttgagcttgccactctgtataattctaacatcctggagaaaaatggcagtttgaccgaacctgttcacaagggtagaggctgatttctaacgaaacttgtagaatgaagcctggaaagagtgatgaattatattatattatataaaaataataataaaaatataaagaaagctacctttcttctatacccaaa

SEQ ID NO: 169966 - DNA, 457 bp, Homo sapiens
  Payload ID: 13464
  Gene Symbol: PATE1
  Gene Name: prostate and testis expressed 1
  Uniprot ID: Q8WXA2
  ENST ID: ENST00000437148
  CDS Start-End: 9-353
tttccaaaatggacaagtccctcttgctggaactccccatcctgctctgctgctttagggcattatctggatcactttcaatgagaaatgatgcagtgatagaaattgttcagtgtaggatgtgccacctccagttcccaggagaaaagtgctccagaggaagaggaatatgcacagcaacaacagaagaggcctgcatggttggaaggatgttcaaaagggatggtaatccctggttaaccttcatgggctgcctaaagaactgtgctgatgtgaaaggcataaggtggagtgtctatttggtgaacttcaggtgctgcaggagccatgacctgtgcaatgaagacctttagaagttaatggttcttctgtgactccaatttctgggtgaggttgttgcctcagcctcttcacaatgactttctaaaaaaaatcacacacacacacacacacacta

SEQ ID NO: 169967 - DNA, 1657 bp, Homo sapiens
  Payload ID: 13465
  Gene Symbol: PATE2
  Gene Name: prostate and testis expressed 2
  Uniprot ID: Q6UY27
  ENST ID: ENST00000358524
  CDS Start-End: 47-388
caacttgctccttccacaggaagctgcacctgacagaagctccaggatgcttgttctctttctcctgggcacagtctttctgctctgcccatattggggtgaacttcatgaccctataaaagcgactgaaataatgtgttatgaatgtaaaaaatatcatcttgggttatgctatggtgtcatgacatcctgctccctgaagcataaacagtcctgtgcagttgagaacttttacatccttacaaggaaagggcagagcatgtatcattattcaaaactgtcgtgtatgaccagctgtgaggacatcaacttcctggggttcacgaagagggtagagctcatctgttgtgatcatagtaactactgcaacctccctgagggagtttagttctacgtctctcctggattttgggttctttttcaaccactacgctctttttctcttccctgaacctgaattttgctctcctcttctatgcattggtagagagtgagaaagccagctcatagtgaaaagacaagcaggcataaggagacgcagtgtggacagcggagcctattgatgatggagcactagactcactctttgcacatccctgtcgctaacaggtgggaggggttttgctctccttacgtgatactgccatgaataagctcagacttggtcatttattatctcctgtatgaaaatgtgaacacttgggccataataatctccaatttgtactgagaattctgtgactatcctctatcctcatctacacacacactcctctccgttggaattctctttggattagccctgacactttctggcactgtccttttctgcccgtgggttctggagagggctaaccccagcttcccagtgtgttggcagcatgggccaagtctttctctgatagagctcttgggggaacctcagggcagaaaaaaaaaaactgaacagacatagggatgagcatcaaagaaaacttcagggggcatttcaactggtaaaaactaagatctgagaaataacttgctgtgggtggaattggcttgaattatcattgccctggctggccaggcagccttgggcacatggttgaactaggtgattggattgggaacagagtgtttttttaaggatggctagtcaggttcttctcatgggactgagcaaacaaaatgctgataatgtggcaggtggtgtagtagttgaagataataggatgtaaatagataccatgaggtagtgttcaagtaacagagtgccctgtgtaagaggaagttatgagtttgcagaaagtgtgagaaaggtagcatatatgggtaacagtggtgggaagagaagaaggaagacacagaaacagataggaagagaaactgagtagcattgatgttggagcacacctgtggccaaggtggcacattttccttggatacacactaaccctggtgtttctgtccttataaggctgactgcaccctagatgacgggttgatgggtgcagcaaaccaccatggcacatgtatacctatgtaacaaacctgcatgctgcactttctttcatgtatcccagaacttaaagtaaaataaaaaaataaataaataaataaaggccagaaaaattggccaaaaaatctgaatagaaaaagatatacagatagtaaa

SEQ ID NO: 169968 - DNA, 738 bp, Homo sapiens
  Payload ID: 13465
  Gene Symbol: PATE2
  Gene Name: prostate and testis expressed 2
  Uniprot ID: Q6UY27
  ENST ID: ENST00000436890
  CDS Start-End: 38-250
ccttccacaggaagctgcacctgacagaagctccaggatgcttgttctctttctcctgggcacagtctttctgctctgcccatattggggtgaacttcatgaccctataaaagggcagagcatgtatcattattcaaaactgtcgtgtatgaccagctgtgaggacatcaacttcctggggttcacgaagagggtagagctcatctgttgtgatcatagtaactactgcaacctccctgagggagtttagttctacgtctctcctggattttgggttctttttcaaccactacgctctttttctcttccctgaacctgaattttgctctcctcttctatgcattggtagagagtgagaaagccagctcatagtgaaaagacaagcaggcataaggagacgcagtgtggacagcggagcctattgatgatggagcactagactcactctttgcacatccctgtcgctaacaggtgggaggggttttgctctccttacgtgatactgccatgaataagctcagacttggtcatttattatctcctgtatgaaaatgtgaacacttgggccataataatctccaatttgtactgagaattctgtgactatcctctatcctcatctacacacacactcctctccgttggaattctctttggattagccctgacactttctggcactgtccttttctgcccgtgggttctggagagggctaaccccagcttcccagtgtgttg

SEQ ID NO: 169969 - DNA, 1336 bp, Homo sapiens
  Payload ID: 13466
  Gene Symbol: PATE3
  Gene Name: prostate and testis expressed 3
  Uniprot ID: B3GLJ2
  ENST ID: ENST00000445202
  CDS Start-End: 42-338
ccctagcttctttttcctgcacaagggatttccgggtcaggatgaacaaacacttcttgttcctcttcctcctttactgcctcattgtggcagtgacatcacttcagtgcataacatgccaccttcgcacacggacagaccgctgtagaagaggctttggtgtctgtactgctcagaagggcgaggcatgcatgctcttaaggatttaccagcgcaatactctccagatatcatacatggtgtgtcagaaattctgcagagacatgacatttgatctcaggaatcggacttatgttcatacatgctgcaactacaattactgtaactttaaactctaagatatttgccctcctgaggtctcgctttggaatgtccccaatgttgctcatccttcacactctgctggcccttgcttcccttccgtgtctgtcctgacaatacccctgccctcgcattaacctaagaagactaaactagtgtgatcctttctggtgtcttcagcttggcttctccctcagtcagagaatagtggttctgaacaatggatttcttctattattgggattattggcatggccatattccaagaaacctgccccaagagttcctgtacagtaaaatttaaagcaggaacattctagaatcttaatttgcttaactagttcaggtacactagaaagccttcagctaaaaattcacaatatttttatctaaaattcccatgtatccggagaatgactaagcagaaatagcaattaaatggatgatggatactgaagatttttctctacggacaccaagttatttctaccagcaggcagtgcccacttcaaactcaaccattgtgattttcttggcatttacaaactacatccttacactgttattaggagatagcaaacaaggatcttcccggcctctgtgacattcaccgagctctcacacagccactgctactcctatcgagatgtacattcaaggtacatcagaactctcatttcttccccttcctttcctaaaccttctctcttcctttccccctttgccattcacctttactatcacctcccacctccattatcacctccccattgccacacaacctctccctgtagagaggcaggaggtccttcgaagctttgccccatgcgtcagatggcacctgaggcatataacctagggtgggctgcctttcaggatccgtcatcaaagggagtcaaacatagtcaagataccatctaccctgtacagctttcttgagacttgggggcctgggtcaaagagatttgtctgtcccttgctgcccatctttaagtaataaaccgacttcacataa

SEQ ID NO: 169970 - DNA, 1983 bp, Homo sapiens
  Payload ID: 13467
  Gene Symbol: PATE4
  Gene Name: prostate and testis expressed 4
  Uniprot ID: P0C8F1
  ENST ID: ENST00000457514
  CDS Start-End: 45-341
aatacctcactcagcacaccgtctgtcacccaaacaagcatccaatgaggaaaatgaacacactgctccttgtgagcttatcttttctctacctcaaagaggttatgggtctgaagtgtaatacctgcatatacacagaaggatggaagtgtatggcaggccgaggcacttgcattgcaaaagaaaatgagttatgttcaacaacagcctatttcaggggagacaaacatatgtactcaacacatatgtgtaagtataagtgccgggaagaggagtcctccaaaagaggcctgttgagagtgacactgtgctgtgacagaaacttctgtaatgtcttctaatggagcttaggaacttgcagaggatcatctgatcaagatccagaatcaagaccaaccaacatgaactgttttatttcccacaccaaattccacactggcctaagatcccagagagagctgcaggggctgtcctcattgcaatgaaggggctccccacaccccacctccaccactagattcctaaaatcatgagcattgaaacaaaatcctccatgagctatgcttattcttttgtcttctactcctgatttctgatttctatcccttgtaggctaaataatggacccccaaatatttctacatcctaatctctggaacctgtgaatgttaccttacatggcaaaagggactttgaaaatgtgattaaggatcttgagaaggggaggttatcttgcattatctgggggggccctaagtggaatcaaaatgcaaaatgcaataagatgcaagtaaagggagatatgacaaagaagaggaaaagatgatgtgataatggaagcagagattggagccatgtgctttgaagatggaggaataggccataagctaaaactaggaggccactagaagctgaaaaagtcaaggaaataggttctcccctcagagcctccagaaaccagccctgctgacaccttgatttaagccctgtaagactcattttggatgtctggcctccagaactctaagcgggtgtggttttcagccacaaagtgtgtattgttttaagccactaagtttgcaataatttattatagcagcaatgggaaactaatacaatccaaataaacttctaggaattcaaatcattggtaagcctgagtacccaggggccagtctaggtgacaacagtatccaccgctcagggcttacagtgacctgcaggaagagaggaataacagagcacatgctatgaataaatgtggagatcaatttgtggattttaaacttcatgacatgctgcagataatcctttaggtgtatctgtggtaaatggtgccttgctatgttctgaagcaatcaaacatgatgtcctaatagctcaatttatcagttcctcattagcttgtgtactcactgaaattcttttagcagttaatgtccttgtattagtctgttttcatgctgctgataaggacatacccacgactgggcaatttacgaaagaaaggggtttatcggacttacagttccacgtggctggggaagcctcacaatcatggcagaaggtaaaaggcatgtctcacatagtgacagacaagagaagagagattgtgcaggaaaactctcccttataataaccatcagatcttgtgagacttactcactatcacgagaatagcacaggaaaaacctgcccccatgattcaattacctcccaccggtccctcccacaacacgtgggaattgaagatgaaatttgggtggggacacagccaaaccatatcagtccccttcttaaaactctcctctctagctcctatgactgtacatttgtagttctcccacctctctgaagaatcctctgtgagggtctctggggactttgttttgatttgttattgtttttatattcagtctttaacctatgtgaagccacctttgtaatactgccttaagtaaagatccagtattatttttctcc

SEQ ID NO: 169971 - DNA, 897 bp, Homo sapiens
  Payload ID: 13467
  Gene Symbol: PATE4
  Gene Name: prostate and testis expressed 4
  ENST ID: ENST00000534411
  CDS Start-End: 45-224
aatacctcactcagcacaccgtctgtcacccaaacaagcatccaatgaggaaaatgaacacactgctccttgtgagcttatcttttctctacctcaaagagggagacaaacatatgtactcaacacatatgtgtaagtataagtgccgggaagaggagtcctccaaaagaggcctgttgagagtgacactgtgctgtgacagaaacttctgtaatgtcttctaatggagcttaggaacttgcagaggatcatctgatcaagatccagaatcaagaccaaccaacatgaactgttttatttcccacaccaaattccacactggcctaagatcccagagagagctgcaggggctgtcctcattgcaatgaaggggctccccacaccccacctccaccactagattcctaaaatcatgagcattgaaacaaaatcctccatgagctatgcttattcttttgtcttctactcctgatttctgatttctatcccttgtaggctaaataatggacccccaaatatttctacatcctaatctctggaacctgtgaatgttaccttacatggcaaaagggactttgaaaatgtgattaaggatcttgagaaggggaggttatcttgcattatctgggggggccctaagtggaatcaaaatgcaaaatgcaataagatgcaagtaaagggagatatgacaaagaagaggaaaagatgatgtgataatggaagcagagattggagccatgtgctttgaagatggaggaataggccataagctaaaactaggaggccactagaagctgaaaaagtcaaggaaataggttctcccctcagagcctccagaaaccagccctgctgacaccttgatttaagccctgtaagactcattttggatgtctggcc

SEQ ID NO: 169972 - DNA, 5011 bp, Homo sapiens
  Payload ID: 13468
  Gene Symbol: PARM1
  Gene Name: prostate androgen-regulated mucin-like protein 1
  Uniprot ID: Q6UWI2
  ENST ID: ENST00000307428
  CDS Start-End: 213-1145
agaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaagccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctgatattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctcaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 169973 - DNA, 4308 bp, Homo sapiens
  Payload ID: 13468
  Gene Symbol: PARM1
  Gene Name: prostate androgen-regulated mucin-like protein 1
  ENST ID: ENST00000513238
  CDS Start-End: 234-440
ctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaagccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctgatattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcgactgcagatgatgaaagagcgggattcaactttgttttcttttcctgtggccccagtgaaacctcctgccctccctgcacgtctgtgtcttcatttctaaaatgggggtgatgctttcatattgacctcaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttcca

SEQ ID NO: 169974 - DNA, 386 bp, Homo sapiens
  Payload ID: 13469
  Gene Symbol: PRAC1
  Gene Name: prostate cancer susceptibility candidate 1
  Uniprot ID: Q96KF2
  ENST ID: ENST00000290294
  CDS Start-End: 131-304
ccgtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaa

SEQ ID NO: 169975 - DNA, 577 bp, Homo sapiens
  Payload ID: 13470
  Gene Symbol: PRAC2
  Gene Name: prostate cancer susceptibility candidate 2
  Uniprot ID: D3DTV9
  ENST ID: ENST00000422730
  CDS Start-End: 230-502
ggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggttccatacaagtaaatccgaaaaaaagtgtgtgtgggggggtccacaccactaattattatggcgaggaagataaagaagacatggacagaaggcggatggctctgcggcctggctcccgcagaccgaccgccttcttcttccattcgagatggctcgtaccgaacctccttgccttcttcctgggtctctcgggggctggaccaatacatctgccgatgccctggccgaatggcaggcgacatcgggtcctggacccccacacgcagctcagtacccacgaggccccaggccgctggaagcctgtagctccgcggacgatgaaagcctgcccgcaggttctcctggagtggtgagcctctgtcggaagggggcgcccacgtctttttaatggtcctaacacaccagtggaataaatctctaagattcca

SEQ ID NO: 169976 - DNA, 504 bp, Homo sapiens
  Payload ID: 13470
  Gene Symbol: PRAC2
  Gene Name: prostate cancer susceptibility candidate 2
  ENST ID: ENST00000432056
  CDS Start-End: 14-436
taaaacccgaaagatggagcctcaggttcgcgctctgcgttgcgggtgctggaaccgagattcaaaaagagcttccggaggttccatacaagtaaatccgaaaaaaagtgtgtgtgggggggtccacaccactaattattatggcgaggaagataaagaagacatggacagaaggcggatggctctgcggcctggctcccgcagaccgaccgccttcttcttccattcgagatggctcgtaccgaacctccttgccttcttcctgggtctctcgggggctggaccaatacatctgccgatgccctggccgaatggcaggcgacatcgggtcctggacccccacacgcagctcagtacccacgaggccccaggccgctggaagcctgtagctccgcggacgatgaaagcctgcccgcaggttctcctggagtggtgagcctctgtcggaagggggcgcccacgtctttttaatggtcctaacacaccagtggaataaatctctaa

SEQ ID NO: 169977 - DNA, 1020 bp, Homo sapiens
  Payload ID: 13471
  Gene Symbol: PSCA
  Gene Name: prostate stem cell antigen
  Uniprot ID: O43653
  ENST ID: ENST00000301258
  CDS Start-End: 84-428
atttgaggccatataaagtcacctgaggccctctccaccacagcccaccagtgaccacgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgctgccatccttgcgctgctccctgcactcggcctgctgctctggggacccggccagctctaggctctggggggccccgctgcagcccacactgggtgtggtgccccaggcctctgtgccactcctcacacacccggcccagtgggagcctgtcctggttcctgaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaataaacacctgttggataagcc

SEQ ID NO: 169978 - DNA, 551 bp, Homo sapiens
  Payload ID: 13471
  Gene Symbol: PSCA
  Gene Name: prostate stem cell antigen
  ENST ID: ENST00000513264
  CDS Start-End: 83-247
tttgaggccatataaagtcacctgaggccctctccaccacagcccaccagtgaccacgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgtgagtggggggacgacagccgccaggcctaggtctctgccactgaactattaatctttctggccatctgtccgcatctgtgtgctgttttccttccacctgtccccgacccgtcccgcacctgcacccccaacaatcacccagcatctgtccctccagccatcctcctccatctgccactcctccactcatctgtccctccccatcctccatcttccactcctccacccatctgtccctccccatccctgagctcacttactcactcaccccatttctgacgctcagcgggtggtccatctgcctcggacatctggatagggctgagaccagggc

SEQ ID NO: 169979 - DNA, 4627 bp, Homo sapiens
  Payload ID: 13472
  Gene Symbol: PMEPA1
  Gene Name: prostate transmembrane protein, androgen induced 1
  Uniprot ID: Q969W9
  ENST ID: ENST00000265626
  CDS Start-End: 255-968
ctgaacctccctctgggctgggcacgcttggactcctccaaagagcttggaccagcctgagccacatccctgggcttgacttctccagaacaagcctcctggtctttctgggagagctctggcagcatcactgtgcctgtgcagggagagcgggaacccacttcctgcaccggctttctctgagttcttcaggatgaattcgctctggtctagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatg

SEQ ID NO: 169980 - DNA, 4546 bp, Homo sapiens
  Payload ID: 13472
  Gene Symbol: PMEPA1
  Gene Name: prostate transmembrane protein, androgen induced 1
  Uniprot ID: Q969W9
  ENST ID: ENST00000347215
  CDS Start-End: 127-885
acgcgagttcccgtctttcctggtcgtcctccttgggttcgggtgaaagcgcttgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 169981 - DNA, 4845 bp, Homo sapiens
  Payload ID: 13472
  Gene Symbol: PMEPA1
  Gene Name: prostate transmembrane protein, androgen induced 1
  Uniprot ID: Q969W9
  ENST ID: ENST00000341744
  CDS Start-End: 321-1184
ggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 169982 - DNA, 800 bp, Homo sapiens
  Payload ID: 13472
  Gene Symbol: PMEPA1
  Gene Name: prostate transmembrane protein, androgen induced 1
  Uniprot ID: Q969W9
  ENST ID: ENST00000395814
  CDS Start-End: 71-784
ttggaacgagggctgcgggcaccagtgagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggcc

SEQ ID NO: 169983 - DNA, 4519 bp, Homo sapiens
  Payload ID: 13472
  Gene Symbol: PMEPA1
  Gene Name: prostate transmembrane protein, androgen induced 1
  Uniprot ID: Q969W9
  ENST ID: ENST00000395816
  CDS Start-End: 145-858
tggtcgtcctccttgggttcgggtgaaagcgcttgggggttcagtgggccatgatccccgagctgctggagaactgaaggcggacagtctcctgcgaaaccagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 169984 - DNA, 859 bp, Homo sapiens
  Payload ID: 13472
  Gene Symbol: PMEPA1
  Gene Name: prostate transmembrane protein, androgen induced 1
  ENST ID: ENST00000395819
  CDS Start-End: 179-859
gcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcagttgtcatggattcccagtatgcaagtcgcatcagcatcaggagtggaagagtctctgctggtccttaaggtctccaggaggggccagttccatcactggctttgggagcatgaaagtgacaaatccagccatgaatttgcctgagtgtcagtggttaagaatacaaaaagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgg

SEQ ID NO: 169985 - DNA, 831 bp, Homo sapiens
  Payload ID: 13472
  Gene Symbol: PMEPA1
  Gene Name: prostate transmembrane protein, androgen induced 1
  ENST ID: ENST00000414037
  CDS Start-End: 207-831
ctctccaggcccctgccacctgtttgcacatgaccctctacacccgccatagcaatggagaccccgcctcctgctacagttaattaatccttcttttttgcttcacaataaaaatagcatggctcttctgattgtaaaaagtgatatacactccttatttaacgaaaaattcaaagaatttgataaatgacaggcgaaaagtcaaaatgcctgcaattccagcacatggagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcg

SEQ ID NO: 169986 - DNA, 1875 bp, Homo sapiens
  Payload ID: 13473
  Gene Symbol: PTOV1
  Gene Name: prostate tumor overexpressed 1
  Uniprot ID: Q86YD1
  ENST ID: ENST00000391842
  CDS Start-End: 171-1421
agtggttcggccgcggcgaccccactccggcggcgcgtcccccgagcttggtacggctcagcccgtctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctcgggggtcgcggccgccctccgcggcccctcgtggtgcgcgccgtccgctcgcgctcctggcctgccagcccccgaggcccgcagcctccgcggatccgggcccgctcggcccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagcctttt

SEQ ID NO: 169987 - DNA, 327 bp, Homo sapiens
  Payload ID: 13473
  Gene Symbol: PTOV1
  Gene Name: prostate tumor overexpressed 1
  ENST ID: ENST00000597730
  CDS Start-End: 1-129
caggtcctgcagcggaacctggagcaggagcaacagcaacgaggggtgaggtggccggcctccagggctgctcagtctccctccacccccgctgcctgctcaccactggcctctgatttctcgccgtagatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 169988 - DNA, 1577 bp, Homo sapiens
  Payload ID: 13473
  Gene Symbol: PTOV1
  Gene Name: prostate tumor overexpressed 1
  Uniprot ID: Q86YD1
  ENST ID: ENST00000599732
  CDS Start-End: 139-1389
gcgcgtcccccgagcttggtacggctcagcccgtctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctcgggggtcgcggccgccctccgcggcccctcgtggtgcgcgccgtccgctcgcgctcctggcctgccagcccccgaggcccgcagcctccgcggatccgggcccgctcggcccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctgcc

SEQ ID NO: 169989 - DNA, 1413 bp, Homo sapiens
  Payload ID: 13473
  Gene Symbol: PTOV1
  Gene Name: prostate tumor overexpressed 1
  ENST ID: ENST00000601638
  CDS Start-End: 54-1208
ttccctgatgtattttggcgcggtctcctggctctgcgggcccagggctccggatgaggtctcccgccgtcccgacccccgcaaggggccagcttggtgtcgccttcgttcttctgccaccccattcggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactgtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacg

SEQ ID NO: 169990 - DNA, 522 bp, Homo sapiens
  Payload ID: 13473
  Gene Symbol: PTOV1
  Gene Name: prostate tumor overexpressed 1
  ENST ID: ENST00000601093
  CDS Start-End: 1-336
aggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacctg

SEQ ID NO: 169991 - DNA, 995 bp, Homo sapiens
  Payload ID: 13473
  Gene Symbol: PTOV1
  Gene Name: prostate tumor overexpressed 1
  ENST ID: ENST00000594151
  CDS Start-End: 147-995
agctgtctcaggctcgggtgcaatccgtaccctcagtgggttccctttcagtgggttcctttgtccccaggcccattattccgtcctcccctcttccctgatgtattttggcgcggtctcctggctctgcgggcccagggctccggatgaggtctcccgccgtcccgacccccgcaaggggccagcttggtgtcgccttcgttcttctgccaccccattcggtaggggctcccgttcccgccacgccccctgaagttgtggctcgcgcgtcttcccaggactcccccgcgccggagaggcccgcaggaccgccgagcccacactccgctcccgcccgggccccgctcccccgcgccgccttggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggag

SEQ ID NO: 169992 - DNA, 1480 bp, Homo sapiens
  Payload ID: 13473
  Gene Symbol: PTOV1
  Gene Name: prostate tumor overexpressed 1
  ENST ID: ENST00000601612
  CDS Start-End: 147-860
agctgtctcaggctcgggtgcaatccgtaccctcagtgggttccctttcagtgggttcctttgtccccaggcccattattccgtcctcccctcttccctgatgtattttggcgcggtctcctggctctgcgggcccagggctccggatgaggtctcccgccgtcccgacccccgcaaggggccagcttggtgtcgccttcgttcttctgccaccccattcggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactggtgacacgcttctgagcaggggcccctggggacttcaactgcccagcaacatggaggatggtgtcctgaggcctccaaggacggtccccacccctctacgtttccccaataaagccttttaaaaacc

SEQ ID NO: 169993 - DNA, 426 bp, Homo sapiens
  Payload ID: 13473
  Gene Symbol: PTOV1
  Gene Name: prostate tumor overexpressed 1
  ENST ID: ENST00000600793
  CDS Start-End: 1-426
gaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacc

SEQ ID NO: 169994 - DNA, 1443 bp, Homo sapiens
  Payload ID: 13473
  Gene Symbol: PTOV1
  Gene Name: prostate tumor overexpressed 1
  ENST ID: ENST00000600603
  CDS Start-End: 128-1252
gcaatccgtaccctcagtgggttccctttcagtgggttcctttgtccccaggcccattattccgtcctcccctcttccctgatgtattttggcgcggtctcctggctctgcgggcccagggctccggatgaggtctcccgccgtcccgacccccgcaaggggccagcttggtgtcgccttcgttcttctgccaccccattcggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactgtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaac

SEQ ID NO: 169995 - DNA, 1587 bp, Homo sapiens
  Payload ID: 13473
  Gene Symbol: PTOV1
  Gene Name: prostate tumor overexpressed 1
  Uniprot ID: Q86YD1
  ENST ID: ENST00000601675
  CDS Start-End: 105-1355
ctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctcgggggtcgcggccgccctccgcggcccctcgtggtgcgcgccgtccgctcgcgctcctggcctgccagcccccgaggcccgcagcctccgcggatccgggcccgctcggcccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactgtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaacc

SEQ ID NO: 169996 - DNA, 424 bp, Homo sapiens
  Payload ID: 13474
  Gene Symbol: PRM1
  Gene Name: protamine 1
  Uniprot ID: P04553
  ENST ID: ENST00000312511
  CDS Start-End: 113-268
gcagagctggcccctgactcacagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgaggtgctgccgccccaggtacagaccgcgatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcctgtcaataaatgttgaaaagtcatccca

SEQ ID NO: 169997 - DNA, 680 bp, Homo sapiens
  Payload ID: 13475
  Gene Symbol: PRM2
  Gene Name: protamine 2
  Uniprot ID: P04554
  ENST ID: ENST00000241808
  CDS Start-End: 111-419
agaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaacgagcaaaagtcacctgcccaataaagcttgacaagaca

SEQ ID NO: 169998 - DNA, 723 bp, Homo sapiens
  Payload ID: 13475
  Gene Symbol: PRM2
  Gene Name: protamine 2
  Uniprot ID: P04554
  ENST ID: ENST00000435245
  CDS Start-End: 111-533
agaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagagagtccctaggtgaccccctcaaccagaactttctttcccaaaaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaacgagcaaaagtcacctgcccaataaagcttgacaagac

SEQ ID NO: 169999 - DNA, 424 bp, Homo sapiens
  Payload ID: 13476
  Gene Symbol: PRM3
  Gene Name: protamine 3
  Uniprot ID: Q9NNZ6
  ENST ID: ENST00000327157
  CDS Start-End: 47-358
acccaccgcctcacctccttgcccagagagacaggcaacgtagaccatgggttcccgctgtgccaagctcaacacaggccagagcccaggccacagcccaggccacagcacgggccatggccggggccacgaatcctccatgaaaaagctcatggcctgtgtgagtcaggataacttctccttgtcatcagcgggcgaggaagaggaggaagaggaggaggagggggaagaggaggagaaagaagagctgccggtgcagggcaagctgctgctgctggagcctgagcggcaggaggagggccacaaggacaacgccgaggcccagcagagccccgagcccaagcggacaccctcctgacccgcaacgaaggcccaggaagggacgcccactgctgctccggcgacagtgttcagagaagagtca

SEQ ID NO: 170000 - DNA, 1293 bp, Homo sapiens
  Payload ID: 13477
  Gene Symbol: PRSS22
  Gene Name: Protease, serine 22
  ENST ID: ENST00000634299
  CDS Start-End: 1-936
gtaggggccctggggttgagagacttgagagtctccctgggcactggagggctagaggttcctcaccaccagaaaggggctggggtgagaggggcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggagtatgtcaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccagatctggatctggatctgcggcggcctcgggcggtttcccccgccgtaaataggctcatctacctctgggggcccggacggctgctgcggaaaggaaaccccctccccgacccgcccgacggcctcaggccccgcctccaaggcatcaggccccgcccaacggcctcatgtccccgcccccacgacttccggccccgcccccgggccccaccgcttttgtgtatataaatgttaatgatttttataggtatttgtaaccctgcccacatatcttatttattcctccaatttcaataaattatttattctcc

SEQ ID NO: 170001 - DNA, 972 bp, Homo sapiens
  Payload ID: 13477
  Gene Symbol: PRSS22
  Gene Name: Protease, serine 22
  ENST ID: ENST00000634552
  CDS Start-End: 1-972
tgggctgtgggcaaagcttggggtgcaggcctagggattgggattccgggggtgggttgtaggaagttggagattcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggctctgccccactgctctgtgccgccaggccagccctctcctgcccctcgtcttcctctttttcctctcctctccctgctcctgtcctgtttctcctccttgtcaactctcattctccgaccctcagttttgtgggtgcctgtccctttaccccat

SEQ ID NO: 170002 - DNA, 1349 bp, Homo sapiens
  Payload ID: 13477
  Gene Symbol: PRSS22
  Gene Name: Protease, serine 22
  ENST ID: ENST00000634511
  CDS Start-End: 39-992
ctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccagatctggatctggatctgcggcggcctcgggcggtttcccccgccgtaaataggctcatctacctctgggggcccggacggctgctgcggaaaggaaaccccctccccgacccgcccgacggcctcaggccccgcctccaaggcatcaggccccgcccaacggcctcatgtccccgcccccacgacttccggccccgcccccgggccccaccgcttttgtgtatataaatgttaatgatttttataggtatttgtaaccctgcccacatatcttatttattcctccaatttcaataaattatttattctcc

SEQ ID NO: 170003 - DNA, 1130 bp, Homo sapiens
  Payload ID: 13478
  Gene Symbol: PRSS27
  Gene Name: protease, serine 27
  Uniprot ID: Q9BQR3
  ENST ID: ENST00000302641
  CDS Start-End: 56-928
ccaacgcttctgccaccgccgaccacggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagctg

SEQ ID NO: 170004 - DNA, 1297 bp, Homo sapiens
  Payload ID: 13478
  Gene Symbol: PRSS27
  Gene Name: protease, serine 27
  ENST ID: ENST00000565903
  CDS Start-End: 392-514
ctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcggggttcagggctaggtcacggaggagtcggctctgggcgcttccttcctgaggagaggagctgggcaggccgggccgacgggttgggccgcatagccgggcctgtgctcatctccagcataaaactccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgc

SEQ ID NO: 170005 - DNA, 1363 bp, Homo sapiens
  Payload ID: 13478
  Gene Symbol: PRSS27
  Gene Name: protease, serine 27
  ENST ID: ENST00000562249
  CDS Start-End: 392-514
ctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcggggttcagggctaggtcacggaggagtcggctctgggcgcttccttcctgaggagaggagctgggcaggccgggccgacgggttgggccgcatagccgggcctgtgctcatctccagcataaaactccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaaggtgggagcaatgtggtgtccatggggactcagtccccaccgccaggcccagggcagggtgggatcatgccccgctccatgggctatgcattcaaccagctgagcagcttgttttgaaaaggcagattccagggccgggtgtggtggctcacgcctgtaatcccagcactttgggaggccaaggagggtggatcacaaggtcaggagatggagaccatcctggctaacacagtgaaaccccatctctactaaaaatacaaaaaattagccaggcgtggtggtgggcgcctgtagtcccagctacttgggaggctgaggcaggagaatggcgcgaacctgggaggcggagcttgcagtgagccgagatcgcgccagtgcactccagcctgggccacagagcaagactccgtctcaataaaaaaaaaaaagaaaaagcagattcctggaccccaccccag

SEQ ID NO: 170006 - DNA, 800 bp, Homo sapiens
  Payload ID: 13479
  Gene Symbol: PRSS1
  Gene Name: protease, serine, 1 (trypsin 1)
  Uniprot ID: P07477
  ENST ID: ENST00000311737
  CDS Start-End: 7-750
accaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttctc

SEQ ID NO: 170007 - DNA, 803 bp, Homo sapiens
  Payload ID: 13479
  Gene Symbol: PRSS1
  Gene Name: protease, serine, 1 (trypsin 1)
  ENST ID: ENST00000486171
  CDS Start-End: 18-803
aggcacactctaccaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcggcaattaagtcaaaattttcaggaagagggtgtgaatatcaccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaa

SEQ ID NO: 170008 - DNA, 626 bp, Homo sapiens
  Payload ID: 13479
  Gene Symbol: PRSS1
  Gene Name: protease, serine, 1 (trypsin 1)
  ENST ID: ENST00000492062
  CDS Start-End: 1-429
tccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttct

SEQ ID NO: 170009 - DNA, 787 bp, Homo sapiens
  Payload ID: 13479
  Gene Symbol: PRSS1
  Gene Name: protease, serine, 1 (trypsin 1)
  ENST ID: ENST00000622109
  CDS Start-End: 18-731
aggcacactctaccaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttctcactgtc

SEQ ID NO: 170010 - DNA, 800 bp, Homo sapiens; identical to SEQ ID NO: 170006
  Payload ID: 13479
  Gene Symbol: PRSS1
  Gene Name: protease, serine, 1 (trypsin 1)
  Uniprot ID: P07477
  ENST ID: ENST00000616256
  CDS Start-End: 7-750

SEQ ID NO: 170011 - DNA, 802 bp, Homo sapiens
  Payload ID: 13479
  Gene Symbol: PRSS1
  Gene Name: protease, serine, 1 (trypsin 1)
  ENST ID: ENST00000612126
  CDS Start-End: 7-750
accaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcac

SEQ ID NO: 170012 - DNA, 787 bp, Homo sapiens; identical to SEQ ID NO: 170009
  Payload ID: 13479
  Gene Symbol: PRSS1
  Gene Name: protease, serine, 1 (trypsin 1)
  ENST ID: ENST00000619214
  CDS Start-End: 18-731

SEQ ID NO: 170013 - DNA, 803 bp, Homo sapiens; identical to SEQ ID NO: 170007
  Payload ID: 13479
  Gene Symbol: PRSS1
  Gene Name: protease, serine, 1 (trypsin 1)
  ENST ID: ENST00000633245
  CDS Start-End: 18-803

SEQ ID NO: 170014 - DNA, 626 bp, Homo sapiens; identical to SEQ ID NO: 170008
  Payload ID: 13479
  Gene Symbol: PRSS1
  Gene Name: protease, serine, 1 (trypsin 1)
  ENST ID: ENST00000633149
  CDS Start-End: 1-429

SEQ ID NO: 170015 - DNA, 4809 bp, Homo sapiens
  Payload ID: 13480
  Gene Symbol: PRSS12
  Gene Name: protease, serine, 12 (neurotrypsin, motopsin)
  Uniprot ID: P56730
  ENST ID: ENST00000296498
  CDS Start-End: 284-2911
gctgcgtccgcgccttctcttttccggtcctctccgccggccggggctcggctgagctccagatttccccacccgcggccgccgccaggggacaggagccgaggcgcggcagggcaccagcggcgggaggcaaggttggggaggcgagggcggtccgcgtgcgggggcgggagggggctgggggattcgagggacgcggcagccccgcccccgccccctcctcttctccgctccaagcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgaggacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagagtgccacccactgacacttccctgtaactgacttatacctgcaggttttcccaagcccaacctgatacaatccaatcttaaaatatactagtcaaaatgctttcctggcctacacattgaaaagttctaatacatacagcagttataacatatgccaggcactgcattaggcagctttgcacatcactgacaatttgcaaaaggccagtaaatcttatggtagtagcccttgttttcaaatgggggaaaacaggcttgcctcaaagtgagaccagttggtgaaactgattccaaactccagaaaaaatgctgatttttttccccatggttctcctacctaaatgattggtttccctatggctatttctccaagagttaagggatagctgcttaactatgcacctttacagaacattcttagcagtaatgctcaaatttaaaaggcacactcaagatacttccatgtcatggatccttccccaggtcccagtagtataaatatagggaagaggttagcatgaacttacaaattgttttaagtaatcctcttgaatgccagtcattaaaggactttgcccttctacatcaaattacatccttttcacaaatccccatttctgtaataactggtgcaaacctaaaggtgctttatagttttactactttgcagatttgcaatgctgcatataatgcagaagagcattaaaaacttttgtaaaaactcatgattttgataaacttttaaagtagcgtttatatgtaaatagaactacacatggcacacacacttgcacaagggcttcagaaaaacgtgcaatataggtgagaaaaatgtctattgaaactttctcacaggctgcccttataattaaactagtgttggggcaagcaacatctgtttcaagtagatcagggactagcaaacctaaaaggcagcaagcagcctgcagtttgctcaatccttaagaatacatggttcatacaacatgcttttactatgtcttaagtgtgacttttgaaagatacaagtgttctgtgcatatttgtgtaaataaatacataattttccaccttgta

SEQ ID NO: 170016 - DNA, 2716 bp, Homo sapiens
  Payload ID: 13481
  Gene Symbol: PRSS16
  Gene Name: protease, serine, 16 (thymus)
  Uniprot ID: Q9NQE7
  ENST ID: ENST00000230582
  CDS Start-End: 16-1560
agagtcccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtggtatcccgaagcctaatgagcaccgcgatcggcgggtccctggagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgca

SEQ ID NO: 170017 - DNA, 1464 bp, Homo sapiens
  Payload ID: 13481
  Gene Symbol: PRSS16
  Gene Name: protease, serine, 16 (thymus)
  ENST ID: ENST00000454665
  CDS Start-End: 38-475
aaaggtcctcctgggggagaacagagtcccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtg

SEQ ID NO: 170018 - DNA, 1949 bp, Homo sapiens
  Payload ID: 13481
  Gene Symbol: PRSS16
  Gene Name: protease, serine, 16 (thymus)
  ENST ID: ENST00000421826
  CDS Start-End: 38-811
aaaggtcctcctgggggagaacagagtcccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttt

SEQ ID NO: 170019 - DNA, 560 bp, Homo sapiens
  Payload ID: 13481
  Gene Symbol: PRSS16
  Gene Name: protease, serine, 16 (thymus)
  ENST ID: ENST00000468930
  CDS Start-End: 8-286
gaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacaggccatcccgcagccttggccccagcctggggcgccctggtgataagcctggaacacagattttatggcctgagtatacctgctggaggcctggaaatggcccagctccgcttcttgtccagccgccttgcattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctccca

SEQ ID NO: 170020 - DNA, 414 bp, Homo sapiens
  Payload ID: 13481
  Gene Symbol: PRSS16
  Gene Name: protease, serine, 16 (thymus)
  ENST ID: ENST00000485993
  CDS Start-End: 1-414
agtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcac

SEQ ID NO: 170021 - DNA, 558 bp, Homo sapiens
  Payload ID: 13481
  Gene Symbol: PRSS16
  Gene Name: protease, serine, 16 (thymus)
  ENST ID: ENST00000466364
  CDS Start-End: 8-307
gaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgc

SEQ ID NO: 170022 - DNA, 623 bp, Homo sapiens
  Payload ID: 13481
  Gene Symbol: PRSS16
  Gene Name: protease, serine, 16 (thymus)
  ENST ID: ENST00000470870
  CDS Start-End: 8-508
gaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcac

SEQ ID NO: 170023 - DNA, 492 bp, Homo sapiens
  Payload ID: 13481
  Gene Symbol: PRSS16
  Gene Name: protease, serine, 16 (thymus)
  ENST ID: ENST00000475106
  CDS Start-End: 1-492
agtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcac

SEQ ID NO: 170024 - DNA, 806 bp, Homo sapiens
  Payload ID: 13482
  Gene Symbol: PRSS2
  Gene Name: protease, serine, 2 (trypsin 2)
  ENST ID: ENST00000633114
  CDS Start-End: 7-756
accaccatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctc

SEQ ID NO: 170025 - DNA, 795 bp, Homo sapiens
  Payload ID: 13482
  Gene Symbol: PRSS2
  Gene Name: protease, serine, 2 (trypsin 2)
  Uniprot ID: P07478
  ENST ID: ENST00000632112
  CDS Start-End: 1-744
atgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctca

SEQ ID NO: 170026 - DNA, 807 bp, Homo sapiens
  Payload ID: 13482
  Gene Symbol: PRSS2
  Gene Name: protease, serine, 2 (trypsin 2)
  ENST ID: ENST00000632805
  CDS Start-End: 17-757
ggcacactctaccaccatgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcggcaattaactcaaaattatcaggaagagggtgtgaatatcaccgcatccaggtgagactgggagagcacaacatcgaagtcctggaggggaatgaacagttcatcaatgcggccaagatcatccgccaccccaaatacaacagccggactctggacaatgacatcctgctgatcaagctctcctcacctgccgtcatcaattcccgcgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctc

SEQ ID NO: 170027 - DNA, 795 bp, Homo sapiens
  Payload ID: 13482
  Gene Symbol: PRSS2
  Gene Name: protease, serine, 2 (trypsin 2)
  Uniprot ID: P07478
  ENST ID: ENST00000539842
  CDS Start-End: 1-744
atgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcggccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctca

SEQ ID NO: 170028 - DNA, 852 bp, Homo sapiens
  Payload ID: 13482
  Gene Symbol: PRSS2
  Gene Name: protease, serine, 2 (trypsin 2)
  ENST ID: ENST00000633969
  CDS Start-End: 17-802
ggcacactctaccaccatgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcggcaattaactcaaaattatcaggaagagggtgtgaatatcaccgcatccaggtgagactgggagagcacaacatcgaagtcctggaggggaatgaacagttcatcaatgcggccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctc

SEQ ID NO: 170029 - DNA, 886 bp, Homo sapiens
  Payload ID: 13482
  Gene Symbol: PRSS2
  Gene Name: protease, serine, 2 (trypsin 2)
  ENST ID: ENST00000634019
  CDS Start-End: 49-834
agattgcaaggacaacagtgaggctgcataaaaagaacctatgacaggatgcacatgagagagacaaatgtcttcacattgaagaaggggaggagtgcgccattggttttccatcctccagaggcactgattgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcggccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 170030 - DNA, 817 bp, Homo sapiens
  Payload ID: 13482
  Gene Symbol: PRSS2
  Gene Name: protease, serine, 2 (trypsin 2)
  ENST ID: ENST00000632998
  CDS Start-End: 18-761
aggcacactctaccaccatgaatccactcctgatccttgcctttgtgggagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcggccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtc

SEQ ID NO: 170031 - DNA, 1101 bp, Homo sapiens
  Payload ID: 13483
  Gene Symbol: PRSS21
  Gene Name: protease, serine, 21 (testisin)
  Uniprot ID: Q9Y6M0
  ENST ID: ENST00000005995
  CDS Start-End: 43-987
gagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 170032 - DNA, 1106 bp, Homo sapiens
  Payload ID: 13483
  Gene Symbol: PRSS21
  Gene Name: protease, serine, 21 (testisin)
  Uniprot ID: Q9Y6M0
  ENST ID: ENST00000450020
  CDS Start-End: 90-992
gagctcccaccccgccccgcccccagggggcgccccgggcccggcgcgagaggaggcagagggggcgtcaggccgcgggagaggaggccatgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaa

SEQ ID NO: 170033 - DNA, 873 bp, Homo sapiens
  Payload ID: 13483
  Gene Symbol: PRSS21
  Gene Name: protease, serine, 21 (testisin)
  ENST ID: ENST00000574813
  CDS Start-End: 1-656
tgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctccca

SEQ ID NO: 170034 - DNA, 809 bp, Homo sapiens
  Payload ID: 13483
  Gene Symbol: PRSS21
  Gene Name: protease, serine, 21 (testisin)
  ENST ID: ENST00000570594
  CDS Start-End: 1-244
gcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccttgccaccactcccagcccaggaaagcatcctgtgtccctgtgccttatttgaccctcatgccaaccccgggaggtggagactgttgccccactctgcagatgcagaaacggaggcttggctgctgccag

SEQ ID NO: 170035 - DNA, 860 bp, Homo sapiens
  Payload ID: 13483
  Gene Symbol: PRSS21
  Gene Name: protease, serine, 21 (testisin)
  ENST ID: ENST00000574265
  CDS Start-End: 1-770
ggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccgctactctttttccctcttctctgggctctcccactcctggggccggtctgagcctacctgagcccatgcagcctggggccactgccaagtcaggccctggttctcttctgtcttgtttggtaataaacacattccagttga

SEQ ID NO: 170036 - DNA, 626 bp, Homo sapiens
  Payload ID: 13483
  Gene Symbol: PRSS21
  Gene Name: protease, serine, 21 (testisin)
  ENST ID: ENST00000570629
  CDS Start-End: 1-246
gcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacgcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatgggtgactcaggtggacccttggcctgtaacaagaatggactgtggtatcagat

SEQ ID NO: 170037 - DNA, 1106 bp, Homo sapiens; identical to SEQ ID NO: 170032
  Payload ID: 13483
  Gene Symbol: PRSS21
  Gene Name: protease, serine, 21 (testisin)
  ENST ID: ENST00000634454
  CDS Start-End: 90-992

SEQ ID NO: 170038 - DNA, 873 bp, Homo sapiens; identical to SEQ ID NO: 170033
  Payload ID: 13483
  Gene Symbol: PRSS21
  Gene Name: protease, serine, 21 (testisin)
  ENST ID: ENST00000634525
  CDS Start-End: 1-656

SEQ ID NO: 170039 - DNA, 1101 bp, Homo sapiens; identical to SEQ ID NO: 170031
  Payload ID: 13483
  Gene Symbol: PRSS21
  Gene Name: protease, serine, 21 (testisin)
  ENST ID: ENST00000634351
  CDS Start-End: 43-987

SEQ ID NO: 170040 - DNA, 626 bp, Homo sapiens; identical to SEQ ID NO: 170036
  Payload ID: 13483
  Gene Symbol: PRSS21
  Gene Name: protease, serine, 21 (testisin)
  ENST ID: ENST00000635401
  CDS Start-End: 1-246

SEQ ID NO: 170041 - DNA, 809 bp, Homo sapiens; identical to SEQ ID NO: 170034
  Payload ID: 13483
  Gene Symbol: PRSS21
  Gene Name: protease, serine, 21 (testisin)
  ENST ID: ENST00000634924
  CDS Start-End: 1-244

SEQ ID NO: 170042 - DNA, 860 bp, Homo sapiens; identical to SEQ ID NO: 170035
  Payload ID: 13483
  Gene Symbol: PRSS21
  Gene Name: protease, serine, 21 (testisin)
  ENST ID: ENST00000635090
  CDS Start-End: 1-770

SEQ ID NO: 170043 - DNA, 1386 bp, Homo sapiens
  Payload ID: 13484
  Gene Symbol: PRSS22
  Gene Name: protease, serine, 22
  Uniprot ID: Q9GZN4
  ENST ID: ENST00000161006
  CDS Start-End: 67-1020
acacaccctgacccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccacatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgccccgggccccagcgcttttgtgtatataaatgttaatgatttttataggtatttgtaaccctgcccacatatcttatttattcctccaatttcaataaattatttattctccagtg

SEQ ID NO: 170044 - DNA, 1037 bp, Homo sapiens
  Payload ID: 13484
  Gene Symbol: PRSS22
  Gene Name: protease, serine, 22
  ENST ID: ENST00000571228
  CDS Start-End: 51-674
atcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccacatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgccccgggccccagcgcttttgtgtatataaatgttaatgatttttataggtatttgtaaccctgcccacatatcttatttattcctccaatttcaataaattatttattctcca

SEQ ID NO: 170045 - DNA, 850 bp, Homo sapiens
  Payload ID: 13484
  Gene Symbol: PRSS22
  Gene Name: protease, serine, 22
  ENST ID: ENST00000576381
  CDS Start-End: 1-350
atctcctttccgcttctgctctgtttatctcttgctccttaactgctctgtgcctcggtttcttctacggctgtgaggatgaaacagaaaacgcagcaagtacgcagcgcgcctcggtctccagttaccgtcggcgtcgccatcgcctgctccctctcgcctccgtgttctcccatctcctcgtcctccgctgcttgcctctggggaagcaccgttttgtgttgttcctgccgcaggaggtcaggggagggcacaccagcggcagcagcgtccagagccgaggggctcagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcgg

SEQ ID NO: 170046 - DNA, 4015 bp, Homo sapiens
  Payload ID: 13485
  Gene Symbol: PRSS23
  Gene Name: protease, serine, 23
  Uniprot ID: O95084
  ENST ID: ENST00000280258
  CDS Start-End: 426-1577
cgcgggtcccgggcaggagagcccgccagagccggtgctgcctggcgccgagaggcccggactggcgactgctgccgcgccaccggggcccacctgcgcagggacgctcggcctcaggccctctgggctgctccaccctgctccggccgcaggcgagcggcgaggggaggggggcacggtttatgtgcagtggggcgggcggcgtccgcgcggcttccccgaggccggaggcggggcgggcgggcctcgggtggcgcggggggcggacccgccagctgcctgcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaa

SEQ ID NO: 170047 - DNA, 613 bp, Homo sapiens
  Payload ID: 13485
  Gene Symbol: PRSS23
  Gene Name: protease, serine, 23
  ENST ID: ENST00000527521
  CDS Start-End: 151-613
attgcctctgtcagtgtgacaggttccacagagctgtcaccctgcaaactcacccttcctccaggagcacaggcgcagagctgcagtggagggtacctgtgtggcttccttgtctgacacagatttgccttcatctgaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtga

SEQ ID NO: 170048 - DNA, 2172 bp, Homo sapiens
  Payload ID: 13485
  Gene Symbol: PRSS23
  Gene Name: protease, serine, 23
  ENST ID: ENST00000532234
  CDS Start-End: 143-391
gcgctgctcgccagcttgctcgcactcggctgtgcggcggggcaggcatgggagccgcgcgctctctcccggcgcccacacctgtctgagcggcgcagcgagccgcggcccgggcgggctgctcggcgcggatggctccctaatgagtagaatgagacctgtgtgccaaccctggcctagtcctcatgcccccacaactgtgaagcgagagggctcaacagtttcgaattcaattcaaccaccacctcctgaataccaactaggttccaggacctggctagaagcagagacaccaggacagaaaagacagtgttctgctttcatggagttcacagaagagtcgaggagagcttcacatttttcatccattcttaaaattgagccagtttagccctaggaggtgggcaggctctgaggaatcatcaatcaagagaagagaacatcgccagaaacaccatgctgcagtacaaaaattctataaaaataccttttttgagtcattaacataaaatgaagaaaacagcagcagccaagaagagagatgttgaaatttaagagaggaagacagagaagaaaaatccactggataccttatgtgtaattcaccaatctgttggaacacttctgccacgtgtgaagagttttggcagaccaaatccacatgcctgaagtgatgcccaccaacaaagacataaaaattttcaacatttcaacagccatgttggaatcatctgcagaataccgaaaaagtgcccagttggagatttcataaaaataacaggcaatcacacacgttgcaggaactgtgtacagtactgagaacaccccaatcttgaccatcagtctttctaacttgtctgtctttgtcccatccttttgaagatttgaccgaattttgaacaaggccaccaaacctgcagcaatgaacaaagttccaatgaccaaataagtaaagaggggagccaccacgaacccggtgagggcatcgagattttggtttccaacatagcacaagccagtcagttcatctgcatccaccagtctcataatcaagatgacaatggttttcactgcggggatggcccaggctgcaatgtggaaataagagctgtgcatttcaatggcttcatgaccccatttgagtcctgctgccaaaaaccaagtgagtgtcagaataacccaccaaatggagctggccattccaaaaaagtacatcagcaagaaaattattgcacatcctgtgttcttaagtccttcttggatgagaacaggttctgctgcctcttcaaaatcacaggatatcctttcccggcctacagtcagcctgacaatataagcaatgctataaatattatagcacatactgagaaatatgatggggcgctcagggtaggaaaacctagaagaatcgatcaggaaggtcagtactgtgaaggcagtggagatgaaacacaggctggcccacacagccatccagatatcagtgaactccttggctgagcggctgtataagccagcatcatagccacacttgagcacacagttcaggctccttttcacccagatgtactgatcagaattggttcccacagagtgacactcttccccaggctggatgggggttttgtgaggtaagggcacctcttcatcacctggcccttccatgcacatgtggttgtggtcgttctgtggtgggaatttgctgcagttcagactctctggccaggcaaatccaaattccttcaggacgggttcacagcgtctcttgactgaaagacacatgccgccgcatgggccaatggggatgttgatcttctctgtgcacattggcacataaacagaacaaaggaagaactggaaaagtaacaaaatgaacacacacaaaaaaaacaatgacttggaagtttgaccaaatgctcccacaaagctgagttgaatgcttccaggcaatctaggtatctacttttaaaccaacctatcgggagtctgtctgtttactctgacctcaaacaagggcgcctgataatccatcacttacatacttttcttagtttggctttagtaatcctttccagaagaatgtacataaataaataaataaaataaatagggtctgaagaattgcataagccctctttgcacaacacttgaaataaatcttaaaaaactggc

SEQ ID NO: 170049 - DNA, 2043 bp, Homo sapiens
  Payload ID: 13485
  Gene Symbol: PRSS23
  Gene Name: protease, serine, 23
  ENST ID: ENST00000533902
  CDS Start-End: 143-418
gcgctgctcgccagcttgctcgcactcggctgtgcggcggggcaggcatgggagccgcgcgctctctcccggcgcccacacctgtctgagcggcgcagcgagccgcggcccgggcgggctgctcggcgcggatggctccctaatgagtagaatgagacctgtgtgccaaccctggcctagtcctcatgcccccacaactgtgaagcgagagggctcaacagtttcgaattcaattcaaccaccacctcctgaataccaactaggttccaggacctggctagaagcagagacaccaggacagaaaagacagtgttctgctttcatggagttcacagaagagtcgaggagaattcaccaatctgttggaacacttctgccacgtgtgaagagttttggcagaccaaatccacatgcctgaagtgatgcccaccaacaaagacataaaaattttcaacatttcaacagccatgttggaatcatctgcagaataccgaaaaagtgcccagttggagatttcataaaaataacaggcaatcacacacgttgcaggaactgtgtacagtactgagaacaccccaatcttgaccatcagtctttctaacttgtctgtctttgtcccatccttttgaagatttgaccgaattttgaacaaggccaccaaacctgcagcaatgaacaaagttccaatgaccaaataagtaaagaggggagccaccacgaacccggtgagggcatcgagattttggtttccaacatagcacaagccagtcagttcatctgcatccaccagtctcataatcaagatgacaatggttttcactgcggggatggcccaggctgcaatgtggaaataagagctgtgcatttcaatggcttcatgaccccatttgagtcctgctgccaaaaaccaagtgagtgtcagaataacccaccaaatggagctggccattccaaaaaagtacatcagcaagaaaattattgcacatcctgtgttcttaagtccttcttggatgagaacaggttctgctgcctcttcaaaatcacaggatatcctttcccggcctacagtcagcctgacaatataagcaatgctataaatattatagcacatactgagaaatatgatggggcgctcagggtaggaaaacctagaagaatcgatcaggaaggtcagtactgtgaaggcagtggagatgaaacacaggctggcccacacagccatccagatatcagtgaactccttggctgagcggctgtataagccagcatcatagccacacttgagcacacagttcaggctccttttcacccagatgtactgatcagaattggttcccacagagtgacactcttccccaggctggatgggggttttgtgaggtaagggcacctcttcatcacctggcccttccatgcacatgtggttgtggtcgttctgtggtgggaatttgctgcagttcagactctctggccaggcaaatccaaattccttcaggacgggttcacagcgtctcttgactgaaagacacatgccgccgcatgggccaatggggatgttgatcttctctgtgcacattggcacataaacagaacaaaggaagaactggaaaagtaacaaaatgaacacacacaaaaaaaacaatgacttggaagtttgaccaaatgctcccacaaagctgagttgaatgcttccaggcaatctaggtatctacttttaaaccaacctatcgggagtctgtctgtttactctgacctcaaacaagggcgcctgataatccatcacttacatacttttcttagtttggctttagtaatcctttccagaagaatgtacataaataaataaataaaataaatagggtctgaagaattgcataagccctctttgcacaacacttgaaataaatcttaaaaaactggctttcaatctccttccattttagaaactatttgaaaaagctaaagaaactaatatgactcatttaggtggtttatttttatccccgtttctttatcattttaaaaataaaagttaaaaaaaaa

SEQ ID NO: 170050 - DNA, 1144 bp, Homo sapiens
  Payload ID: 13486
  Gene Symbol: PRSS3
  Gene Name: protease, serine, 3
  Uniprot ID: P35030
  ENST ID: ENST00000342836
  CDS Start-End: 309-1094
ggagttcctggggccagagacatctccaagggaaggtcaagggcctggaggatgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacaggttgccaggacaaccgtgaggctgcataaaaagaacctatgacaggatgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctc

SEQ ID NO: 170051 - DNA, 966 bp, Homo sapiens
  Payload ID: 13486
  Gene Symbol: PRSS3
  Gene Name: protease, serine, 3
  Uniprot ID: P35030
  ENST ID: ENST00000361005
  CDS Start-End: 1-915
atgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacagttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctca

SEQ ID NO: 170052 - DNA, 834 bp, Homo sapiens
  Payload ID: 13486
  Gene Symbol: PRSS3
  Gene Name: protease, serine, 3
  Uniprot ID: P35030
  ENST ID: ENST00000379405
  CDS Start-End: 40-783
gacaggccttccaccaccagtcaggcacactctaccaccatgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctca

SEQ ID NO: 170053 - DNA, 623 bp, Homo sapiens
  Payload ID: 13486
  Gene Symbol: PRSS3
  Gene Name: protease, serine, 3
  ENST ID: ENST00000457896
  CDS Start-End: 91-623
ggcgcgggatgcagacggctgcgaggcgctgggcacaggttgccaggacaaccgtgaggctgcataaaaagaacctatgacaggatgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgct

SEQ ID NO: 170054 - DNA, 786 bp, Homo sapiens
  Payload ID: 13486
  Gene Symbol: PRSS3
  Gene Name: protease, serine, 3
  Uniprot ID: P35030
  ENST ID: ENST00000429677
  CDS Start-End: 14-736
ggttccgactcgcatgggacctgcgggggaggttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctc

SEQ ID NO: 170055 - DNA, 1694 bp, Homo sapiens
  Payload ID: 13487
  Gene Symbol: PRSS33
  Gene Name: protease, serine, 33
  Uniprot ID: Q8NF86
  ENST ID: ENST00000293851
  CDS Start-End: 161-1003
ggagctgaggacagacagaaggaccacggagggggtgacgggctggtgtgaggattggtgcccctgggccaggactctcctctcttctccctgctggctccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcagcttctaatgctagccggtgaggctgacctggagccagctgctggggtccctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgc

SEQ ID NO: 170056 - DNA, 1676 bp, Homo sapiens
  Payload ID: 13487
  Gene Symbol: PRSS33
  Gene Name: protease, serine, 33
  Uniprot ID: Q8NF86
  ENST ID: ENST00000570702
  CDS Start-End: 143-985
ccaggacttccgtctgagatgggatttctggacagaacaatggagcgcagaagctccagcaacgtgtgctctgcagggagcccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcagcttctaatgctagccggtgaggctgacctggagccagctgctggggtccctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgc

SEQ ID NO: 170057 - DNA, 1755 bp, Homo sapiens
  Payload ID: 13487
  Gene Symbol: PRSS33
  Gene Name: protease, serine, 33
  ENST ID: ENST00000576886
  CDS Start-End: 295-642
gggggttaggctccagggcttctgtcgagaccaaggatgcccaaatatctgggtggtgggtgctgcatacctgggccctgggcagaacgaagggtatacagcctgggccaccaggataagtccagaacccaccaggagctgaggacagacagaaggaccacggagggggtgacgggctggtgtgaggattggtgcccctgggccaggactctcctctcttctccctgctggctccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccaggtgtgcacccagcctccccagcctccggagtcccctccctgtgcccagcaccctccctccctgaactccaggacccaggacatcccaactcaggctcaggatcctggcctccaacctagaggcaccacgccaggggtctggaaccctgagaactgaagtcctgggagggctgggacttaggctcctctttctcctgcagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcagcttctaatgctagccggtgaggctgacctggagccagctgctggggtccctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgc

SEQ ID NO: 170058 - DNA, 767 bp, Homo sapiens
  Payload ID: 13487
  Gene Symbol: PRSS33
  Gene Name: protease, serine, 33
  ENST ID: ENST00000571674
  CDS Start-End: 59-767
gaccagagtccaagccctaggcagtgccacccttacccagcccagccttgaagacagaatgagaggggtttcctgtctccaggtcctgctccttctggtgctggcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccaggtgtgcacccagcctccccagcctccggagtcccctccctgtgcccagcaccctccct

SEQ ID NO: 170059 - DNA, 1597 bp, Homo sapiens
  Payload ID: 13487
  Gene Symbol: PRSS33
  Gene Name: protease, serine, 33
  ENST ID: ENST00000612593
  CDS Start-End: 65-919
gctccagaccagagtccaagccctaggcagtgccacccttacccagcccagccttgaagacagaatgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagggtgattctgggggacctctgacctgcctgcagtctgggagctgggtcctggtgggcgtggtgagctggggcaagggttgtgccctgcccaaccgtccaggggtctacaccagtgtggccacatatagcccctggattcaggctcgcgtcgcttctaatgctagccggtgaggctgacctggagccagctgctggggtccctcagcctcctggttcatccaggcacctgcctataccccacatcccttctgcctcgaggccaagatgcctaaaaaagctaaaggccaccccaccccccacccaccacctcctgcctcctctcctctttggggatcaccagctctgactccaccaaccctcatccaggaatctgccatgagtcccagggagtcacactccccactcccttcctggcttgtatttacttttcttggccctggccagggctgggcgcaaggcacgcagtgatgggcaaaccaattgctgcccatctggcctgtgtgcccatctttttctggagaaagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgc

SEQ ID NO: 170060 - DNA, 2440 bp, Homo sapiens
  Payload ID: 13488
  Gene Symbol: PRSS35
  Gene Name: protease, serine, 35
  Uniprot ID: Q8N3Z0
  ENST ID: ENST00000369700
  CDS Start-End: 178-1419
tctcagtggcgagctctgggtgctgtggcccggccttggcggggcggcctccggctcaggctggctgagaggctcccagctgcagcgtccccgcccgcctcctcgggagctctgatctcagctgacagtgccctcggggaccaaacaagcctggcaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcgggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatgacttaaaa

SEQ ID NO: 170061 - DNA, 2840 bp, Homo sapiens
  Payload ID: 13489
  Gene Symbol: PRSS36
  Gene Name: protease, serine, 36
  Uniprot ID: Q5K4E3
  ENST ID: ENST00000268281
  CDS Start-End: 60-2627
gacagagccctgcagggagcagaccttcacttggctctgcctccgctgactctagcgccatggcccggcacctgctcctcccccttgtgatgcttgtcatcagtcccatcccaggagccttccaggactcagctctcagtcctacccaggaagaacctgaagatctggactgcgggcgccctgagccctcggcccgcatcgtggggggctcaaacgcgcagccgggcacctggccttggcaagtgagcctgcaccatggaggtggccacatctgcgggggctccctcatcgccccctcctgggtcctctccgctgctcactgtttcatgacgaatgggacgctggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggtgactctggggggcccctggtctgtgaggaaggcggccgctggttccaggcaggaatcaccagctttggctttggctgtggacggagaaaccgccctggagttttcactgctgtggctacctatgaggcatggatacgggagcaggtgatgggttcagagcctgggcctgcctttcccacccagccccagaagacccagtcagatccccaggagcccagggaggagaactgcaccattgccctgcctgagtgcgggaaggccccgcggccaggggcctggccctgggaggcccaggtgatggtgccaggatccagaccctgccatggggcgctggtgtctgaaagctgggtcttggcacctgccagctgctttctggacccgaacagctccgacagcccaccccgcgacctcgacgcctggcgcgtgctgctgccctcgcgcccgcgcgcggagcgggtggcgcgcctggtgcagcacgagaacgcttcgtgggacaacgcctcggacctggcgctgctgcagctgcgcacgcccgtgaacctgagcgcggcttcgcggcccgtgtgcctaccccacccggaacactacttcctgcccgggagccgctgccgcctggcccgctggggccgcggggaacccgcgcttggcccaggcgcgctgctggaggcggagctgttaggcggctggtggtgccactgcctgtacggccgccagggggcggcagtaccgctgcccggagacccgccgcacgcgctctgccctgcctaccaggaaaaggaggaggtgggcagctgctggaatgactcgcgttggagccttttgtgccaggaggaggggacctggtttctggctggaatcagagactttcccagtggctgtctacgtccccgagccttcttccctctgcagactcatggcccatggatcagccatgtgactcggggagcctacctggaggaccagctagcctgggattggggccctgatggggaggagactgagacacagacttgtcccccacacacagagcatggtgcctgtggcctgcggctggaggctgctccagtgggggtcctgtggccctggctggcagaggtgcatgtggctggtgatcgagtctgcactgggatcctcctggccccaggctgggtcctggcagccactcactgtgtcctcaggccaggctctacaacagtgccttacattgaagtgtatctgggccgggcaggggccagctccctcccacagggccaccaggtatcccgcttggtcatcagcatccggctgccccagcacctgggactcaggccccccctggccctcctggagctgagctcccgggtggagccctccccatcagccctgcccatctgtctccacccggcgggtatccccccgggggccagctgctgggtgttgggctggaaagaaccccaggaccgagtccctgtggctgctgctgtctccatcttgacacaacgaatctgtgactgcctctatcagggcatcctgccccctggaaccctctgtgtcctgtatgcagaggggcaggagaacaggtgtgagatgacctcagcaccgcccctcctgtgccagatgacggaagggtcctggatcctcgtgggcatggctgttcaagggagccgggagctgtttgctgccattggtcctgaagaggcctggatctcccagacagtgggagaggccaacttcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtggcccagccggctggaacctcaagggccccacccaccgagattgcagcggctctggctaattgggcctcagtgcccgggctattttgaacccaggaatccttgggggtggtgggaggagcggacaataaaggtgtaaacacagg

SEQ ID NO: 170062 - DNA, 2446 bp, Homo sapiens
  Payload ID: 13489
  Gene Symbol: PRSS36
  Gene Name: protease, serine, 36
  Uniprot ID: Q5K4E3
  ENST ID: ENST00000418068
  CDS Start-End: 32-2290
acttggctctgcctccgctgactctagcgccatggcccggcacctgctcctcccccttgtgatgcttgtcatcagtcccatcccaggagccttccaggactcagctctcagtcctacccaggaagaacctgaagatctggactgcgggcgccctgagccctcggcccgcatcgtggggggctcaaacgcgcagccgggcacctggccttggcaagtgagcctgcaccatggaggtggccacatctgcgggggctccctcatcgccccctcctgggtcctctccgctgctcactgtttcatgacgaatgggacgctggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggtgactctggggggcccctggtctgtgaggaaggcggccgctggttccaggcaggaatcaccagctttggctttggctgtggacggagaaaccgccctggagttttcactgctgtggctacctatgaggcatggatacgggagcaggtgatgggttcagagcctgggcctgcctttcccacccagccccagaagacccagtcagatccccaggagcccagggaggagaactgcaccattgccctgcctgagtgcgggaaggccccgcggccaggggcctggccctgggaggcccaggtgatggtgccaggatccagaccctgccatggggcgctggtgtctgaaagctgggtcttggcacctgccagctgctttctggacccgaacagctccgacagcccaccccgcgacctcgacgcctggcgcgtgctgctgccctcgcgcccgcgcgcggagcgggtggcgcgcctggtgcagcacgagaacgcttcgtgggacaacgcctcggacctggcgctgctgcagctgcgcacgcccgtgaacctgagcgcggcttcgcggcccgtgtgcctaccccacccggaacactacttcctgcccgggagccgctgccgcctggcccgctggggccgcggggaacccgcgcttggcccaggcgcgctgctggaggcggagctgttaggcggctggtggtgccactgcctgtacggccgccagggggcggcagtaccgctgcccggagacccgccgcacgcgctctgccctgcctaccaggaaaaggaggaggtgggcagctgctggaatgactcgcgttggagccttttgtgccaggaggaggggacctggtttctggctggaatcagagactttcccagtggctgtctacgtccccgagccttcttccctctgcagactcatggcccatggatcagccatgtgactcggggagcctacctggaggaccagctagcctgggattggggccctgatggggaggagactgagacacagacttgtcccccacacacagagcatggtgcctgtggcctgcggctggaggctgctccagtgggggtcctgtggccctggctggcagaggtgcatgtggctggtgatcgagtctgcactgggatcctcctggccccaggctgggtcctggcagccactcactgtgtcctcaggccaggctctacaacagtgccttacattgaagtgtatctgggccgggcaggggccagctccctcccacagggccaccagatgacctcagcaccgcccctcctgtgccagatgacggaagggtcctggatcctcgtgggcatggctgttcaagggagccgggagctgtttgctgccattggtcctgaagaggcctggatctcccagacagtgggagaggccaacttcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtggcccagccggctggaacctcaagggccccacccaccgagattgcagcggctctggctaattgggcctcagtgcccgggctattttg

SEQ ID NO: 170063 - DNA, 2723 bp, Homo sapiens
  Payload ID: 13489
  Gene Symbol: PRSS36
  Gene Name: protease, serine, 36
  Uniprot ID: Q5K4E3
  ENST ID: ENST00000569305
  CDS Start-End: 27-2579
gctctgcctccgctgactctagcgccatggcccggcacctgctcctcccccttgtgatgcttgtcatcagtcccatcccaggagccttccaggactcagctctcagtcctacccaggaagaacctgaagatctggactgcgggcgccctgagccctcggcccgcatcgtggggggctcaaacgcgcagccgggcacctggccttggcaagtgagcctgcaccatggaggtggccacatctgcgggggctccctcatcgccccctcctgggtcctctccgctgctcactgtttcatgacgaatgggacgctggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggtgactctggggggcccctggtctgtgaggaaggcggccgctggttccaggcaggaatcaccagctttggctttggctgtggacggagaaaccgccctggagttttcactgctgtggctacctatgaggcatggatacgggagcaggtgatgggttcagagcctgggcctgcctttcccacccagccccagaagacccagtcagatccccaggagcccagggaggagaactgcaccattgccctgcctgagtgcgggaaggccccgcggccaggggcctggccctgggaggcccaggtgatggtgccaggatccagaccctgccatggggcgctggtgtctgaaagctgggtcttggcacctgccagctgctttctggacccgaacagctccgacagcccaccccgcgacctcgacgcctggcgcgtgctgctgccctcgcgcccgcgcgcggagcgggtggcgcgcctggtgcagcacgagaacgcttcgtgggacaacgcctcggacctggcgctgctgcagctgcgcacgcccgtgaacctgagcgcggcttcgcggcccgtgtgcctaccccacccggaacactacttcctgcccgggagccgctgccgcctggcccgctggggccgcggggaacccgcgcttggcccaggcgcgctgctggaggcggagctgttaggcggctggtggtgccactgcctgtacggccgccagggggcggcagtaccgctgcccggagacccgccgcacgcgctctgccctgcctaccaggaaaaggaggagaatgactcgcgttggagccttttgtgccaggaggaggggacctggtttctggctggaatcagagactttcccagtggctgtctacgtccccgagccttcttccctctgcagactcatggcccatggatcagccatgtgactcggggagcctacctggaggaccagctagcctgggattggggccctgatggggaggagactgagacacagacttgtcccccacacacagagcatggtgcctgtggcctgcggctggaggctgctccagtgggggtcctgtggccctggctggcagaggtgcatgtggctggtgatcgagtctgcactgggatcctcctggccccaggctgggtcctggcagccactcactgtgtcctcaggccaggctctacaacagtgccttacattgaagtgtatctgggccgggcaggggccagctccctcccacagggccaccaggtatcccgcttggtcatcagcatccggctgccccagcacctgggactcaggccccccctggccctcctggagctgagctcccgggtggagccctccccatcagccctgcccatctgtctccacccggcgggtatccccccgggggccagctgctgggtgttgggctggaaagaaccccaggaccgagtccctgtggctgctgctgtctccatcttgacacaacgaatctgtgactgcctctatcagggcatcctgccccctggaaccctctgtgtcctgtatgcagaggggcaggagaacaggtgtgagatgacctcagcaccgcccctcctgtgccagatgacggaagggtcctggatcctcgtgggcatggctgttcaagggagccgggagctgtttgctgccattggtcctgaagaggcctggatctcccagacagtgggagaggccaacttcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtggcccagccggctggaacctcaagggccccacccaccgagattgcagcggctctggctaattgggcctcagtgcc

SEQ ID NO: 170064 - DNA, 528 bp, Homo sapiens
  Payload ID: 13489
  Gene Symbol: PRSS36
  Gene Name: protease, serine, 36
  ENST ID: ENST00000571878
  CDS Start-End: 1-86
acattgaagtgtatctgggccgggcaggggccagctccctcccacagggccaccagtccctgtggctgctgctgtctccatcttgacacaacgaatctgtgactgcctctatcagggcatcctgccccctggaaccctctgtgtcctgtatgcagaggggcaggagaacaggtgtgagatgacctcagcaccgcccctcctgtgccagatgacggaagggtcctggatcctcgtgggcatggctgttcaagggagccgggagctgtttgctgccattggtcctgaagaggcctggatctcccagacagtgggagaggccaacttcctgccccccagtggctccccacactggcccactggaggcagcaatctctgccccccagaactggccaaggcctcgggatccccgcatgcagtctacttcctgctcctgctgactctcctgatccagagctgaggggctagggtcccagcaccacttcccccttctccaccctctacttcccgcccagtggggctggaatgtgg

SEQ ID NO: 170065 - DNA, 1189 bp, Homo sapiens
  Payload ID: 13490
  Gene Symbol: PRSS37
  Gene Name: protease, serine, 37
  Uniprot ID: A4D1T9
  ENST ID: ENST00000350549
  CDS Start-End: 373-1080
agaaactctgtggggaagataagtcctgagcctagagctgccatttccacagacaactgaactaccttcaaacagatgtgtttttaggggcagcagatagaaggagctgaatccaggagtttccttccctgaaatgccccaacagaggcacagtcctccaccttccctggaacagagggctttcatctgtctctctgaagccatctccctcccctgtttatgcccagagctgctttccaatcccatggagtgcctccgtatctaaccatagccactgagtctaccaggtgttcctgagaagacaactaagccaaccgctccacactctgctgattttcttctacatctcacagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttaccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaatttgggaatgtagc

SEQ ID NO: 170066 - DNA, 874 bp, Homo sapiens
  Payload ID: 13490
  Gene Symbol: PRSS37
  Gene Name: protease, serine, 37
  ENST ID: ENST00000452758
  CDS Start-End: 163-360
cccctgtttatgcccagagctgctttccaatcccatggagtgcctccgtatctaaccatagccactgagtctaccaggtgttcctgagaagacaactaagccaaccgctccacactctgctgattttcttctacatctcacagggggaagagctggatcaccatgaaatatgtcttctatttgggtgtcctcgctgaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttaccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgc

SEQ ID NO: 170067 - DNA, 1834 bp, Homo sapiens
  Payload ID: 13490
  Gene Symbol: PRSS37
  Gene Name: protease, serine, 37
  ENST ID: ENST00000419085
  CDS Start-End: 51-257
aaacctcaggacacttactccctgagctaagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttacctatgaatgcattttatcacttaaagatctagcaggtaactgatgatgcactcaaattgggtcaattgaggtgagttttaagaaggaaccaattgcaaaggtatggagacattaaagggacaatattaagaatagttccataccaccagggtttgtattaagaaaatgcagttaccacctctaggcctaaaaaggcaagaggagaagataatttcaaaggaggcaaggagagatagagaaaaagcgagacctgtgtgaggagacagcctgataaggattgtaacccctagtcaaggagcacagccactctgtgacaaaactgcagggagggacctgggaggataagtactccaatctcactcttcttcctccagttactttctggtgcttcctattggccaatagaaggaagccagaggacaagagagcccactgattaaatccatatatgtccccttccaaaggtgcagagcagaatggaataggactgttagtgcatcagctagggaaccaaacaggagacacccagaactaggttatttattctctggtctccaccaaaatggacattgttcagttagataggcgagaaaattacatttccttgacatgcatcctcttcctctccactacattaaagaacacaacattaaaatgtagtgaagggctccactacttactatatcaccctgagtgaattactcctatgtgcccccattaattcatgtgctaaatggggataaaaatggaatccactgcatagacttgttgtgagttaaatgacataatccagaaaaagcacttggtacagttcctggcactttgtaacattcagtatcttagcaatgatgatgatgatgatgatgattacttccaacccctctccctccagaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttaccctcgccaccaccaatgtcaggccaggcactgtctgtctactctcaggtttggactggagccaagaaaacagtgggctttggcagctggagccaccaggccatctgactctgcacagaggcccagccattcctgattggcagagacacaattcacatgaacaaggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaa

SEQ ID NO: 170068 - DNA, 826 bp, Homo sapiens
  Payload ID: 13490
  Gene Symbol: PRSS37
  Gene Name: protease, serine, 37
  Uniprot ID: A4D1T9
  ENST ID: ENST00000438520
  CDS Start-End: 53-760
gcaaacctcaggacacttactccctgagctaagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttaccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccct

SEQ ID NO: 170069 - DNA, 1267 bp, Homo sapiens
  Payload ID: 13491
  Gene Symbol: PRSS38
  Gene Name: protease, serine, 38
  Uniprot ID: A1L453
  ENST ID: ENST00000366757
  CDS Start-End: 25-1005
gctgggggcgctgcctcgagcctcatggctgcccctgcttccgtcatgggcccactcgggccctctgccctgggccttctgctgctgctcctggtggtggcccctccccgggtcgcagcattggtccacagacagccagagaaccagggaatctccctaactggcagcgtggcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtgagacctcagacgagctgcaggagatgcagctcccgctgatcctggagccctggtgccacctgctctacggacacatgtcctacatcatgcccgacatgctgtgtgctggggacatcctgaatgctaagaccgtgtgtgagggcgactccgggggcccacttgtctgtgaattcaaccgcagctggttgcagattggaattgtgagctggggccgaggctgctccaaccctctgtaccctggagtgtatgccagtgtttcctatttctcaaaatggatatgtgataacatagaaatcacgcccactcctgctcagccagcccctgctctctctccagctctggggcccactctcagcgtcctaatggccatgctggctggctggtcagtgctgtgaggtcaggatacccactctaggattctcatggctgcacaccctgccccagcccagctgcctccagacccctaagcatctcctgtcctggcctctctgaagcagacaagggccacctatcccgggggtggatgctgagtccaggaggtgatgagcaagtgtacaaaagaaaaaagggaagggggagaggggctggtcagggagaacccagcttgggcagagtgcacctgagatttgataagatcattaaatatttacaaagcaa

SEQ ID NO: 170070 - DNA, 1280 bp, Homo sapiens
  Payload ID: 13492
  Gene Symbol: PRSS42
  Gene Name: protease, serine, 42
  ENST ID: ENST00000447340
  CDS Start-End: 55-357
cctgcggtccgcggcccggggaatctgaagcgtggctcgggagccccgggggacatggcctccttcttggctgtcgtcggggcgcccgggggagtcaactcctgtgtctttgaccgtttccattacagtgtcaagatgggagatcggagtgtctataatgaaaacacaagtgtggtggtctcagtccaaagagcttttgtccaccctaagttctcaacagttacaaccattcgaaatgaccttgcccttctccagctccaacatcctgtgaattttacctcaaacatccagcctatctgcatccctcaggagaatttccaggtggaagggagattctgggggccgcttggcctgtgaatataatgacacatgggtccaggtagggattgtgagctggggcatcggctgtggtcgctgagggttgcctggagtttatacagaaattggtgtctacagtaagtggctgattgcagtggtggatcaggctacctgtttgtatccagcagtgttcctcatcttagtcctgcatttggtgctgcccctgggcatcctggtggcccagtgatcaccccagcccactccccttttgtttctgagtctcatactaggcctctcctccaacctcccactccttctcaatgccgtttctgaaaatcccagttggaatccacgggccctctggagatccatacaatagagcacagcagggagactggggcctggaaagtgcccctgcctggtgctctggtcacctgcctcagccatgcctgcaccagggctgtgctctggctagtgggaaggagggggtgaactaattccagctagaggaccagcctccctgccaggtgggccacagtgactcatcagtatctgggggaacatctatcaaagaagagacatcatcaacagtgaagcaagtgttagatgtggttctggtttcagggctcccacctaagactttgtgaaaccagccagctgggtgattgctcagcgtgaaggaggcgttaccaggtccctgcagaggtgtgaggcctgggacttccactctaggctcagttgtctggggctgggagaagttcccctgcagcccagtgtggatccatctgtgagtggacagcctctgccacactaactctcttggggctacccattcttggcacccccttcctcagtgccctagtggccactttcagagacactacaagttgtattgaggcagttatggagtgcagagttttcagaaatcaactaaataaatgtttggagagtctcctatgttc

SEQ ID NO: 170071 - DNA, 882 bp, Homo sapiens
  Payload ID: 13492
  Gene Symbol: PRSS42
  Gene Name: protease, serine, 42
  Uniprot ID: Q7Z5A4
  ENST ID: ENST00000429665
  CDS Start-End: 1-882
atgtcctctggcggcggctcccggggcctcctggcgtggcttctgctccttcagccctggcccgggcagaactgggcgggcatggcggcgccacgcctcccgtcccctctcctctcagaggagggcggcgagaaccccgaagcgagcccggctccaggacctgaagcgggccccccactcaatctgtttacgtcctttccaggtgactcactgctgtgtggccgaacccctctgagaatcgtgggaggagtggacgcggaggaagggaggtggccctggcaggtgagcgtgaggaccaaaggcaggcacatctgcggcggcaccctggtcaccgccacgtgggtgctgacggcaggccactgcatttccagccgtttccattacagtgtcaagatgggagatcggagtgtctataatgaaaacacaagtgtggtggtctcagtccaaagagcttttgtccaccctaagttctcaacagttacaaccattcgaaatgaccttgcccttctccagctccaacatcctgtgaattttacctcaaacatccagcctatctgcatccctcaggagaatttccaggtggaaggtaggaccaggtgctgggtgaccggatggggcaaaacaccagaacgagagaaacttgcatcagaaattcttcaggatgtggaccaatacatcatgtgctatgaggaatgtaataagataatacagaaggccttgtcatctactaaggatgtaataataaaagggatggtctgtggctataaagaacaaggaaaggattcttgtcaaggagattctgggggccgcttggcctgtgaatataatgacacatgggtccaggtagggattgtgagctggggcatcggctgtggtcgctga

SEQ ID NO: 170072 - DNA, 687 bp, Homo sapiens
  Payload ID: 13493
  Gene Symbol: PRSS45
  Gene Name: protease, serine, 45
  Uniprot ID: Q7RTY3
  ENST ID: ENST00000442359
  CDS Start-End: 1-687
atgacccgccattggccctgggaggtgagcctccggatggaaaatgagcacgtgtgtggaggggccctcattgaccccagctgggtggtgactgcggcccactgcatccaaggcaccaaagagtactcagtggtgcttggcacctccaagctgcagcccatgaacttcagcagggccctctgggtccctgtgagggacatcattatgcaccccaagtactggggccgggccttcatcatgggtgacgttgcccttgtccaccttcaaacacctgtcaccttcagctccacagccaactccatgctgaccccagagctgcaggaggctgaggtgtttatcatggacaacaagaggtgtgaccggcattacaagaagtccttcttccccccagttgtcccccttgtcctgggggacatgatctgtgccaccaattatggggaaaacttgtgctatggggattctggagggccattggcttgtgaagttgagggcagatggattctggctggggtgttgtcctgggaaaaggcctgcgtgaaggcacagaatccaggtgtgtacacccgcatcaccaaatacaccaaatggatcaagaagcaaatgagcaatggagccttctcaggtccctgtgcctctgcctgcctcctgttcctgtgctggctgctgcagccccagatgggctcctga

SEQ ID NO: 170073 - DNA, 3128 bp, Homo sapiens
  Payload ID: 13493
  Gene Symbol: PRSS45
  Gene Name: protease, serine, 45
  ENST ID: ENST00000423292
  CDS Start-End: 2180-2512
agaacccatggccggcgtggaaaccgctgcgaggcggcgccacgacggaggctgaggtcgccggcagtatccatggcgtcccagagcggcagctccctggggctcctggcctggttcttgcttcttcagccatggctcgaagaggcccgggcaggcagggtgggtgcgcagggaggcgtagcactgctcttcccctccgcgctcccctcagggccaggcggccaggaccccggagcgagcggatgggagccgccacctgtaggggctccaggatccccagcggccccccagtccagggggaacgcagtgcgccccgcttcggtgttacttccctcagcctgtggccagcggacttcaaggataactggaggattgccggctccagacaggaagtggccctggcaggtgagcctgcagaccagcaacagacacatctgcggaggctcccttatcgccagacactgggtactcactgccgctcactgcatctctgggtgagggtttggggctcagagcttgggccctgatcaggctgtgggacctggagccagtctgtccccctccctgaacttcctcttcctcatctgtaaaagggggtgacagccccatagtttttatccagtctgggtgagacctgaggatttgcatttctaacaagtttctgggtgttgcctccgccgctgatctggggactactggctaaagtggtcaggggtcctggagggatgtggcttggagagagggaggtagctgctggctggcataggaagatggtaccaggcgggaagcacctcgaaggtgtggaagcagagtgtagaccctggaggatcttcctgcagccatctggaatacacagtgaagctgggagacacaaatgtgcatcatcgctccaaaacagcacttgtggtcccagttcgtgacgtcgttatccaccgatattttacgtctcctggaataattgaaaatgacattgcccttgccctgcttgacttccctgtgaattactccacgcacatccagcttgtgtgcctccctgaacaggctttcatggtgcaagctggtacgaactgctgggtgaccggatggggcaaagtaaatgaaacaggtgagccataccgacccgaggaggattccagaatgaccccggcaagcccagaagcccggacgtctcctgtgcacccgaaattccccaaaattccagaaacttctgtagctccagggtctccagcgaccgcagggcctccaggatcctgggttacttcagcatctacagtgggagaagccttggaatccgacggaatctctgaccttggaaggcagttttctcagggtattgtttctggtgctagatctgtcctggcctgcggggtaggtcaaaggggacacagcctggctcagggaggttgagggtcagaccctgacctagatgatttgagagagaggatagataacccgcctccgccctgggcagcctggtggggtggtgggaaggtagtggcttcacttccagtcccctctctttactgagcccaccagcctgtggccaccgtgtttcaaggatgattggaggattgccagccccaaacaagaagtggccctggcaggtgagcctgcagaccagcaacatacaccactgcggaggctccctcatcgacaggcgctgggtgctcactgccgcccactgtgtctttagtaatttggaatacaaggtgaagctgggagaccctgacttgcatgctggttccaaagaggcactggtgatcccagtttgagacatcatttttcctagcaattttgattttgccactttgacaagcgacattgcccttgctctgctcgcctactctgtgaattattcctcacatatccagcctgcgtgcctccccgaaaagctttttgaagtggaagctgggacagagtgctgggtgactggatggggccaagtgtcagagagtgtttcaggaccaatgccacttgttcttcaggagactgagctaaacattatgcgtcatgagaaatgttgtgagatgctcaagaacaagaatatatccaagagtaaaatggtcacgagggggaccgtctgtggctataatgaccaagggaaggatgcctgtcaggttataaagaggacacaaccaatccagtttgtggtgagccctggtggtcggaggatttggaaatgacccgccattggccctgggaggtgagcctccggatggaaaatgagcacgtgtgtggaggggccctcattgaccccagctgggtggtgactgcggcccactgcatccaaggcaccaaagagtactcagtggtgcttggcacctccaagctgcagcccatgaacttcagcagggccctctgggtccctgtgagggacatcattatgcaccccaagtactggggccgggccttcatcatgggtgacgttgcccttgtccaccttcaaacacctgtcaccttcagtgagctccacagccaactccatgctgaccccagagctgcaggaggctgaggtgtttatcatggacaacaagaggtgtgaccggcattacaagaagtccttcttccccccagttgtcccccttgtcctgggggacatgatctgtgccaccaattatggggaaaacttgtgctatggggattctggagggccattggcttgtgaagttgagggcagatggattctggctggggtgttgtcctgggaaaaggcctgcgtgaaggcacagaatccaggtgtgtacacccgcatcaccaaatacaccaaatggatcaagaagcaaatgagcaatggagccttctcaggtccctgtgcctctgcctgcctcctgttcctgtgctggctgctgcagccccagatgggctcctgacctccctaccttttcctcctcctgccttgcctctgctgaatggggccagatggtttgaccaaggtcatgtgtccatcttcaaaaagagtcagggtggggaagagtaacccctgggagaatgggtctggctttggcatcccggtgaggagaagtgtggtggatgactaggccttgggtgagcaggagaagggaagtgtggcctagaaggattctggaatctgggaccaggagagcagggattaaacatgtgcaaacttg

SEQ ID NO: 170074 - DNA, 1041 bp, Homo sapiens
  Payload ID: 13493
  Gene Symbol: PRSS45
  Gene Name: protease, serine, 45
  Uniprot ID: Q7RTY3
  ENST ID: ENST00000620911
  CDS Start-End: 1-783
atgacccgccattggccctgggaggtgagcctccggatggaaaatgagcacgtgtgtggaggggccctcattgaccccagctgggtggtgactgcggcccactgcatccaaggcaccaaagagtactcagtggtgcttggcacctccaagctgcagcccatgaacttcagcagggccctctgggtccctgtgagggacatcattatgcaccccaagtactggggccgggccttcatcatgggtgacgttgcccttgtccaccttcaaacacctgtcaccttcagtgagtacgtgcagcccatctgcctcccggagcccaatttcaacctgaaggttgggacgcagtgttgggtgactggctggagccaggttaagcagcgcttttcagccaactccatgctgaccccagagctgcaggaggctgaggtgtttatcatggacaacaagaggtgtgaccggcattacaagaagtccttcttccccccagttgtcccccttgtcctgggggacatgatctgtgccaccaattatggggaaaacttgtgctatggggattctggagggccattggcttgtgaagttgagggcagatggattctggctggggtgttgtcctgggaaaaggcctgcgtgaaggcacagaatccaggtgtgtacacccgcatcaccaaatacaccaaatggatcaagaagcaaatgagcaatggagccttctcaggtccctgtgcctctgcctgcctcctgttcctgtgctggctgctgcagccccagatgggctcctgacctccctaccttttcctcctcctgccttgcctctgctgaatggggccagatggtttgaccaaggtcatgtgtccatcttcaaaaagagtcagggtggggaagagtaacccctgggagaatgggtctggctttggcatcccggtgaggagaagtgtggtggatgactaggccttgggtgagcaggagaagggaagtgtggcctagaaggattctggaatctgggaccaggagagcagggattaaacatgtgcaaacttg

SEQ ID NO: 170075 - DNA, 982 bp, Homo sapiens
  Payload ID: 13494
  Gene Symbol: PRSS46
  Gene Name: protease, serine, 46
  Uniprot ID: E5RG02
  ENST ID: ENST00000463091
  CDS Start-End: 42-566
atccgttagaaggagcattgaggagtagatacccacttgccatggcctgtgggccgggggatcttcaaagccttacatctccgctttcctctgccagattagattatcagccgtctattgaagggccctggctccgggcctgcggtcagaccaacgtgtcctgcagggtggtgaaggggaagctggtagaggtaggcaagtggccatggcaggtgagcatccttttcctgggcacgtacatctgcagtggctccctcatccaccaccagtgggtcctcacggctgcgcactgcttgcagagattcaaggacctcagcctgtactccgtgatggtgggagtccaccagcgcccagaaaatagcactcagctcccgctcactcgcatggtgattcataaggatttcagcaatctcatgtctcaggacattgccctcctaaagctcagggactccatctcgtggtcccccttcgtccagcctgtctgcctccctaacatcaaattcaagccatccattggaagcatgtgctgggtaatcggctggggaactacagggaaaaaaggttgactctggaagctcccttgtctgccaaatggacaagacctggattcagataggagtggtaagctggagctttagttgtggccagcgccacttcccaggtatctacaccagcactgcccacttcaaccagtggatcaggactgaggttgctaacataaggttcatcagtagggctggccctgccttcctgagcccagttttcctcactggctacattctactgggctccttgagctccctgtggctcctgtgagcggtgtttcaaggacagtccctcccagaggctgcttctccctcccctctgttctaccctcagaagtggagacgagaggttgcccaggatggcagggcagagtgagggggagggtccgagagccactgttactttctgttgttcaatgaagatgcttttgaacttt

SEQ ID NO: 170076 - DNA, 989 bp, Homo sapiens
  Payload ID: 13495
  Gene Symbol: PRSS48
  Gene Name: protease, serine, 48
  Uniprot ID: Q7RTY5
  ENST ID: ENST00000455694
  CDS Start-End: 3-989
acatgggccctgctggctgtgccttcacgctgctccttctgctggggatctcagtgtgtgggcaacctgtatactccagccgcgttgtaggtggccaggatgctgctgcagggcgctggccttggcaggtcagcctacactttgaccacaactttatctgtggaggttccctcgtcagtgagaggttgatactgacagcagcacactgcatacaaccgacctggactactttttcatatactgtgtggctaggatcgattacagtaggtgactcaaggaaacgtgtgaagtactacgtgtccaaaatcgtcatccatcccaagtaccaagatacaacggcagacgtcgccttgttgaaactgtcctctcaagtcaccttcacttctgccatcctgcctatttgcttgcccagtgtcacaaagcagttggcaattccacccttttgttgggtgaccggatggggaaaagttaaggaaagttcagatagagattaccattctgcccttcaggaagcagaagtacccattattgaccgccaggcttgtgaacagctctacaatcccatcggtatcttcttgccagcactggagccagtcatcaaggaagacaagatttgtgctggtgatactcaaaacatgaaggatagttgcaagggtgattctggagggcctctgtcgtgtcacattgatggtgtatggatccagacaggagtagtaagctggggattagaatgtggtaaatctcttcctggagtctacaccaatgtaatctactaccaaaaatggattaatgccactatttcaagagccaacaatctagacttctctgacttcttgttccctattgtcctactctctctggctctcctgcgtccctcctgtgcctttggacctaacactatacacagagtaggcactgtagctgaagctgttgcttgcatacagggctgggaagagaatgcatggagatttagtcccaggggcagataa

SEQ ID NO: 170077 - DNA, 560 bp, Homo sapiens
  Payload ID: 13495
  Gene Symbol: PRSS48
  Gene Name: protease, serine, 48
  Uniprot ID: Q7RTY5
  ENST ID: ENST00000441586
  CDS Start-End: 3-560
acatgggccctgctggctgtgccttcacgctgctccttctgctggggatctcagatagagattaccattctgcccttcaggaagcagaagtacccattattgaccgccaggcttgtgaacagctctacaatcccatcggtatcttcttgccagcactggagccagtcatcaaggaagacaagatttgtgctggtgatactcaaaacatgaaggatagttgcaagggtgattctggagggcctctgtcgtgtcacattgatggtgtatggatccagacaggagtagtaagctggggattagaatgtggtaaatctcttcctggagtctacaccaatgtaatctactaccaaaaatggattaatgccactatttcaagagccaacaatctagacttctctgacttcttgttccctattgtcctactctctctggctctcctgcgtccctcctgtgcctttggacctaacactatacacagagtaggcactgtagctgaagctgttgcttgcatacagggctgggaagagaatgcatggagatttagtcccaggggcagataa

SEQ ID NO: 170078 - DNA, 1347 bp, Homo sapiens
  Payload ID: 13496
  Gene Symbol: PRSS50
  Gene Name: protease, serine, 50
  Uniprot ID: Q9UI38
  ENST ID: ENST00000315170
  CDS Start-End: 60-1217
gtcgtgggggcggcactgggagcgccttccggagagacgcagtcggctgccaccccgggatgggtcgctggtgccagaccgtcgcgcgcgggcagcgcccccggacgtctgccccctcccgcgccggtgccctgctgctgctgcttctgttgctgaggtctgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtgggtgcagctgtcacagccctgagagtcagggtggagatgaggtgctcaattaaacattactgttttccatgc

SEQ ID NO: 170079 - DNA, 2958 bp, Homo sapiens
  Payload ID: 13496
  Gene Symbol: PRSS50
  Gene Name: protease, serine, 50
  Uniprot ID: Q9UI38
  ENST ID: ENST00000460241
  CDS Start-End: 1672-2829
gctccaagttgccgccagaacccatggccggcgtggaaaccgctgcgaggcggcgccacgacggaggctgaggtcgccggcagtatccatggcgtcccagagcggcagctccctggggctcctggcctggttcttgcttcttcagccatggctcgaagaggcccgggcaggcagggtgggtgcgcagggaggcgtagcactgctcttcccctccgcgctcccctcagggccaggcggccaggaccccggagcgagcggatgggagccgccacctgtaggggctccaggatccccagcggccccccagtccagggggaacgcagtgcgccccgcttcggtgttacttccctcaggtgagccataccgacccgaggaggattccagaatgaccccggcaagcccagaagcccggacgtctcctgtgcacccgaaattccccaaaattccagaaacttctgtagctccagggtctccagcgaccgcagggcctccaggatcctgggttacttcagcatctacagtgggagaagccttggaatccgacggaatctctgaccttggaaggcagttttctcagggtattgtttctggtgctagatctgtcctggcctgcggggtaggtcaaaggggacacagcctggctcagggaggttgagggtcagaccctgacctagatgatttgagagagaggatagataacccgcctccgccctgggcagcctggtggggtggtgggaaggtagtggcttcacttccagtcccctctctttactgagcccaccagcctgtggccaccgtgtttcaaggatgattggaggattgccagccccaaacaagaagtggccctggcaggtgagcctgcagaccagcaacatacaccactgcggaggctccctcatcgacaggcgctgggtgctcactgccgcccactgtgtctttagtttcaggaccaatgccacttgttcttcaggagactgagctaaacattatgcgtcatgagaaatgttgtgagatgctcaagaacaagaatatatccaagagtaaaatggtcacgagggggaccgtctgtggctataatgaccaagggaaggatgcctgtcaggttataaagaggacacaaccaatccaggttgactctggaagctcccttgtctgccaaatggacaagacctggattcagataggagtgttccttgggcaaagccccactggaggggctggagggaaagtagggtcacttggagatcctggatgccagcccctgaggtttggtcttcatctcactgcgggaggggtgacaccatgagccagtccagggcaatgggctgcgagggtgaggaggtctgagaatcggccgagattaagttgagggactccaggagactgcttggaccagcggagtgaggagagggaggggccaaggagggaagtcagccggggcgtacccagcccgggaggtataagggagggctgtcactaggggcgcccttgcgggtcagacaccacgagcgccgtggcgggtggcccctggggggcgccacgcaggcggggcactaggagcatccccacccagctcaccagaggccgcggcatgcggccaacagggggcgccgtcgtgggggcggcactgggagcgccttccggagagacgcagtcggctgccaccccgggatgggtcgctggtgccagaccgtcgcgcgcgggcagcgcccccggacgtctgccccctcccgcgccggtgccctgctgctgctgcttctgttgctgaggtctgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtgggtgcagctgtcacagccctgagagtcagggtggagatgaggtgctcaattaaacattactgttttccatg

SEQ ID NO: 170080 - DNA, 2181 bp, Homo sapiens
  Payload ID: 13497
  Gene Symbol: PRSS53
  Gene Name: protease, serine, 53
  Uniprot ID: Q2L4Q9
  ENST ID: ENST00000280606
  CDS Start-End: 155-1816
tcacacagccacagccccagagctaggaactgctggctagggcaagcagacagctgaatcctagccaactggaggtggagcagaggtggagccagggagacccaggtggcctctctcagagtggagcacaggtggcagagtggcccggggcagcatgaagtggtgctggggcccagtgctgctcatcgcgggtgccacagtcctcatggagggtcttcaagccgctcagcgtgcctgtggacagcgtggccccggcccccccaagcctcaggagggcaacacagtccctggcgagtggccctggcaggccagtgtgaggaggcaaggagcccacatctgcagcggctccctggtggcagacacctgggtcctcactgctgcccactgctttgaaaaggcagcagcaacagaactgaattcctggtcagtggtcctgggttctctgcagcgtgagggactcagccctggggccgaagaggtgggggtggctgccctgcagttgcccagggcctataaccactacagccagggctcagacctggccctgctgcagctcgcccaccccacgacccacacacccctctgcctgccccagcccgcccatcgcttcccctttggagcctcctgctgggccactggctgggatcaggacaccagtgatgctcctgggaccctacgcaatctgcgcctgcgtctcatcagtcgccccacatgtaactgtatctacaaccagctgcaccagcgacacctgtccaacccggcccggcctgggatgctatgtgggggcccccagcctggggtgcagggcccctgtcagggagattccgggggccctgtgctgtgcctcgagcctgacggacactgggttcaggctggcatcatcagctttgcatcaagctgtgcccaggaggacgctcctgtgctgctgaccaacacagctgctcacagttcctggctgcaggctcgagttcagggggcagctttcctggcccagagcccagagaccccggagatgagtgatgaggacagctgtgtagcctgtggatccttgaggacagcaggtccccaggcaggagcaccctccccatggccctgggaggccaggctgatgcaccagggacagctggcctgtggcggagccctggtgtcagaggaggcggtgctaactgctgcccactgcttcattgggcgccaggccccagaggaatggagcgtagggctggggaccagaccggaggagtggggcctgaagcagctcatcctgcatggagcctacacccaccctgaggggggctacgacatggccctcctgctgctggcccagcctgtgacactgggagccagcctgcggcccctctgcctgccctatcctgaccaccacctgcctgatggggagcgtggctgggttctgggacgggcccgcccaggagcaggcatcagctccctccagacagtgcccgtgaccctcctggggcctagggcctgcagccggctgcatgcagctcctgggggtgatggcagccctattctgccggggatggtgtgtaccagtgctgtgggtgagctgcccagctgtgagggcctgtctggggcaccactggtgcatgaggtgaggggcacatggttcctggccgggctgcacagcttcggagatgcttgccaaggccccgccaggccggcggtcttcaccgcgctccctgcctatgaggactgggtcagcagtttggactggcaggtctacttcgccgaggaaccagagcccgaggctgagcctggaagctgcctggccaacataagccaaccaaccagctgctgacaggggacctggccattctcaggacaagagaatgcaggcaggcaaatggcattactgcccctgtcctccccaccctgtcatgtgtgattccaggcaccagggcaggcccagaagcccagcagctgtgggaaggaacctgcctggggccacaggtgcccactccccaccctgcaggacaggggtgtctgtggacactcccacacccaactctgctaccaagcaggcgtctcagctttcctcctcctttaccctttcagatacaatcacgccagccacgttgttttgaaaatttctttttttggggggcagcagttttcctttttttaaacttaaataaattgttacaaaatagactttagaaaata

SEQ ID NO: 170081 - DNA, 1810 bp, Homo sapiens
  Payload ID: 13498
  Gene Symbol: PRSS54
  Gene Name: protease, serine, 54
  Uniprot ID: Q6PEW0
  ENST ID: ENST00000219301
  CDS Start-End: 396-1583
aatggaacattcttcccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcagcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaacca

SEQ ID NO: 170082 - DNA, 1555 bp, Homo sapiens
  Payload ID: 13498
  Gene Symbol: PRSS54
  Gene Name: protease, serine, 54
  ENST ID: ENST00000543437
  CDS Start-End: 444-1334
ttcatttctccttgagcaggaacagttcatggacgaactctgaggaccattctgaggacaagaggcatccagtgtcatgagtggaacatgcagcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtc

SEQ ID NO: 170083 - DNA, 1799 bp, Homo sapiens
  Payload ID: 13498
  Gene Symbol: PRSS54
  Gene Name: protease, serine, 54
  Uniprot ID: Q6PEW0
  ENST ID: ENST00000567164
  CDS Start-End: 385-1572
attcttcccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaacca

SEQ ID NO: 170084 - DNA, 954 bp, Homo sapiens
  Payload ID: 13498
  Gene Symbol: PRSS54
  Gene Name: protease, serine, 54
  ENST ID: ENST00000569727
  CDS Start-End: 396-954
aatggaacattcttcccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcagcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaa

SEQ ID NO: 170085 - DNA, 1057 bp, Homo sapiens
  Payload ID: 13498
  Gene Symbol: PRSS54
  Gene Name: protease, serine, 54
  ENST ID: ENST00000569079
  CDS Start-End: 448-1057
gcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctattcttccaccagaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcaacaggaaatcacatgacgatgagtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctg

SEQ ID NO: 170086 - DNA, 1124 bp, Homo sapiens
  Payload ID: 13499
  Gene Symbol: PRSS55
  Gene Name: protease, serine, 55
  Uniprot ID: Q6UWB4
  ENST ID: ENST00000328655
  CDS Start-End: 41-1099
ggcctctgtcacccccgggcccacagcacagcccagggccatgctcctgttctcagtgttgctgctcctgtccctggtcacgggaactcagctcggtccacggactcctctcccagaggctggagtggctatcctaggcagggctaggggagcccaccgccctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcataagctggggaaagagctgtggagagaagaacaccccagggatatacacctcgttggtgaactacaacctctggatcgagaaagtgacccagctagagggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttca

SEQ ID NO: 170087 - DNA, 2374 bp, Homo sapiens
  Payload ID: 13499
  Gene Symbol: PRSS55
  Gene Name: protease, serine, 55
  ENST ID: ENST00000518641
  CDS Start-End: 1-547
ttggaagcctgctcctcccagcccggtccccagctcacactggatgctgactaagtgtttccccttttcctttccactctctttctttccaccagaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctggtatgtgactgctcagcttcccctggggaaaaagccactgcaatgtgaaggagaggggaggaagctaaggaaggagtgaggacaagacttgcattggagcagattcccgctcagtggagtctcacagtgcccaaagtttagctccttttgggtgccgaaaccccaagctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagacccagcgctgccgcgtgcttctttcctctggattcgaatttcctgggccaccaccgaagatgcaaaggcaaattcaggaaatgcaaatccttaaatggaagcttgggcttttcctggggacctacagcctggctgagtgttctccagaaagagactgaagaaaagcttcctggttgggcgaggtggctcatgcctgtaatcccagcactttgggaggctgagatgggtggatcacctaaggccaggagttcaagaccagtctggccaccacggtgaaaccccgtctctactttaaaaaatacaaaagttagccgggtgtggtggcgggcacctgtaatcccagccaatcgggatcctgaggcaggataacggcttgaacccaggaggtggaggttgcaatgagcggagatcacgccactgcactccggcctgggcatcaagagtgaactctatctccaaaaaaaaagaaaaaagaaaaaaagcttcctagttatcctttttcccactctaaccctactcctccagaggtcctacagctacaatgtctagaagccattttttcagaagctcctaagaacctgggactcaggcaggcccagtggagggtggccagctggagtgttcaccatctcaggacatcaccactgtccactccactttcctgctcaccgccctctgacttctgtgtgggggccctcccttttcacccactctccaatttgcatagttctggatggctggccctttgctgggggctggggtgggcatagaactcgagcctggcctagaaggacattgattttggccacagggatgggagcagcaatgggctgtgggctttataggtcacaagagcaagaccaagacttctgctggagttatcaggaacaagactgactgactctcctgggactcccaacatggtagggtgcatgttgaaggtactgctcatgtgaaggctgctggggagtgtggtggttccttttgtctgtcaacttggaggggatctgtggatgagattgatgtttaaattggtaaactgtgacgaagcagattgccctccataatggggtgagcctcatccaatccgttgaaggcctgagtaggacaaaaatgattggcctccccacacaagagggaattcctcagccgcccaccttcagacttcatctgcattgtcagctcttctggggctctgcctgccagtctctaaaccagagcagcaccaccagctctcctgcatctcgagcctgccagtccacaccccaggtttgagcttgccagtctctgtaatcagggacagaaaactgactgtgtgctctgttgacccagcctcaacaaacaggacatggtggcctgcacctgtgcttctcagaccatctgtgaggaaaaagaccagggcttttggtttttggttttgcttcgaaatttccaacttatttcaaaccaatactttcataaaacataaaattgaactactcgaaaaatgaaatcgaaaatgaacaaataaaatgcaagcccaca

SEQ ID NO: 170088 - DNA, 1005 bp, Homo sapiens
  Payload ID: 13499
  Gene Symbol: PRSS55
  Gene Name: protease, serine, 55
  Uniprot ID: Q6UWB4
  ENST ID: ENST00000522210
  CDS Start-End: 41-871
ggcctctgtcacccccgggcccacagcacagcccagggccatgctcctgttctcagtgttgctgctcctgtccctggtcacgggaactcagctcggtccacggactcctctcccagaggctggagtggctatcctaggcagggctaggggagcccaccgccctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagcaaagctattttcccactttacaaagaatgaacaccggaagctctcaaacaaagccgcctgggtctcacacctttcatctgcaaaactgatgctttgctctttcttctacatggagccatttttggggcagaaaacatacccttgggcatagccttgagttgaaaatctttgagggtgttttctgtccaaatgactgaaaaaatgaataaaagcctccccattt

SEQ ID NO: 170089 - DNA, 2157 bp, Homo sapiens
  Payload ID: 13500
  Gene Symbol: PRSS56
  Gene Name: protease, serine, 56
  ENST ID: ENST00000449534
  CDS Start-End: 137-1951
gatgatttgagggacaagaattcagtgcccgggggccgaaaggcagcagaaggcgggcaccaaaggataggcacccggaaggtggactccgaggaggagagaggacaggggtctctcaccccagctcctggtcaccatgctgctggctgtgctgctgctgctacccctcccaagctcatggtttgcccacgggcacccactgtacacacgcctgccccccagcgccctgcaagttctgtcggcccaggggactcaggcgttgcaggcagcccagaggagcgcccagtgggcaataaaccgagtggcgatggagatccagcacagatcgcacgagtgccgaggatctgggcgccccaggcctcaagctctcctccaggacccacctgagccagggccgtgcggcgagaggcgtccgagcactgccaatgtgacgcgggcccacggccgcatcgtggggggcagcgcggcgccgcccggggcctggccctggctggtgaggctgcagctcggcgggcagcctctgtgcggcggcgtcctggtagcggcctcctgggtgctcacggcagcgcactgctttgtaggcgccccgaatgagcttctgtggactgtgacgctggcagaggggtcccggggggagcaagcggaggaggtgccagtgaaccgcatcctgccccaccccaagtttgacccgcggaccttccacaacgacctggccctggtgcagctgtggacgccggtgagcccggggggatcggcgcgccccgtgtgcctgccccaggagccccaggagccccctgccggaaccgcctgcgccatcgcgggctggggcgccctcttcgaagacgggcctgaggctgaagcagtgagagaggcccgtgttcccctgctcagcaccgacacctgccgaagagccctggggcccgggctgcgccccagcaccatgctctgcgccgggtacctggcggggggcgttgactcgtgccagggtgactcgggaggccccctgacctgttctgagcctggcccccgccctagagaggtcctgttcggagtcacctcctggggggacggctgcggggagccagggaagcccggggtctacacccgcgtggcagtgttcaaggactggctccaggagcagatgagcgcagcctcctccagccgcgagcccagctgcagggagcttctggcctgggaccccccccaggagctgcaggcagacgccgcccggctctgcgccttctatgcccgcctgtgcccggggtcccagggcgcctgtgcgcgcctggcgcaccagcagtgcctgcagcgccggcggcgatgcgagctgcgctcgctggcgcacacgctgctgggcctgctgcggaacgcgcaggagctgctcgggcctcgtccgggactgcggcgcctggcccccgccctggctctccccgctccagcgctcagggagtctcctctgcaccccgcccgggagctgcggcttcactcaggatcgcgggctgcaggcactcggttcccgaagcggaggccggagccgcgcggagaagccaacggctgccctgggctggagcccctgcgacagaagttggctgccctgcagggggcccatgcctggatcctgcaggtcccctcggagcacctggccatgaactttcatgaggtcctggcagatctgggctccaagacactgaccgggcttttcagagcctgggtgcgggcaggcttggggggccggcatgtggccttcagcggcctggtgggcctggagccggccacactggctcgcagcctcccccggctgctggtgcaggccctgcaggccttccgcgtggctgccctggcagaaggggagcccgagggaccctggatggatgtagggcaggggcccgggctggagaggaaggggcaccacccactcaaccctcaggtaccccccgccaggcaaccctgagccatgtctgggcccccagcccctggggaggacctactgctcccaggggctgagaggggttcgggagcataatgacaaactgtcgctgccccagtggctgggtgtgtgtgggtgggatggggtgggggtcctgggccccccgtgtcttcccaggtttacaatcagagaatcacagctgctttaataaatgttatttataatacacg

SEQ ID NO: 170090 - DNA, 2158 bp, Homo sapiens
  Payload ID: 13500
  Gene Symbol: PRSS56
  Gene Name: protease, serine, 56
  Uniprot ID: P0CW18
  ENST ID: ENST00000617714
  CDS Start-End: 137-1948
gatgatttgagggacaagaattcagtgcccgggggccgaaaggcagcagaaggcgggcaccaaaggataggcacccggaaggtggactccgaggaggagagaggacaggggtctctcaccccagctcctggtcaccatgctgctggctgtgctgctgctgctacccctcccaagctcatggtttgcccacgggcacccactgtacacacgcctgccccccagcgccctgcaagttctgtcggcccaggggactcaggcgttgcaggcagcccagaggagcgcccagtgggcaataaaccgagtggcgatggagatccagcacagatcgcacgagtgccgaggatctgggcgccccaggcctcaagctctcctccaggacccacctgagccagggccgtgcggcgagaggcgtccgagcactgccaatgtgacgcgggcccacggccgcatcgtggggggcagcgcggcgccgcccggggcctggccctggctggtgaggctgcagctcggcgggcagcctctgtgcggcggcgtcctggtagcggcctcctgggtgctcacggcagcgcactgctttgtaggcgccccgaatgagcttctgtggactgtgacgctggcagaggggtcccggggggagcaagcggaggaggtgccagtgaaccgcatcctgccccaccccaagtttgacccgcggaccttccacaacgacctggccctggtgcagctgtggacgccggtgagcccggggggatcggcgcgccccgtgtgcctgccccaggagccccaggagccccctgccggaaccgcctgcgccatcgcgggctggggcgccctcttcgaagacgggcctgaggctgaagcagtgagagaggcccgtgttcccctgctcagcaccgacacctgccgaagagccctggggcccgggctgcgccccagcaccatgctctgcgccgggtacctggcggggggcgttgactcgtgccagggtgactcgggaggccccctgacctgttctgagcctggcccccgccctagagaggtcctgttcggagtcacctcctggggggacggctgcggggagccagggaagcccggggtctacacccgcgtggcagtgttcaaggactggctccaggagcagatgagcgcctcctccagccgcgagcccagctgcagggagcttctggcctgggaccccccccaggagctgcaggcagacgccgcccggctctgcgccttctatgcccgcctgtgcccggggtcccagggcgcctgtgcgcgcctggcgcaccagcagtgcctgcagcgccggcggcgatgcgagctgcgctcgctggcgcacacgctgctgggcctgctgcggaacgcgcaggagctgctcgggcctcgtccgggactgcggcgcctggcccccgccctggctctccccgctccagcgctcagggagtctcctctgcaccccgcccgggagctgcggcttcactcaggatcgcgggctgcaggcactcggttcccgaagcggaggccggagccgcgcggagaagccaacggctgccctgggctggagcccctgcgacagaagttggctgccctgcagggggcccatgcctggatcctgcaggtcccctcggagcacctggccatgaactttcatgaggtcctggcagatctgggctccaagacactgaccgggcttttcagagcctgggtgcgggcaggcttggggggccggcatgtggccttcagcggcctggtgggcctggagccggccacactggctcgcagcctcccccggctgctggtgcaggccctgcaggccttccgcgtggctgccctggcagaaggggagcccgagggaccctggatggatgtagggcaggggcccgggctggagaggaaggggcaccacccactcaaccctcaggtaccccccgccaggcaaccctgagccatgtctgggcccccagcccctggggaggacctactgctcccaggggctgagaggggttcgggagcataatgacaaactgtcgctgccccagtggctgggtgtgtgtgggtgggatggggtgggggtcctgggccccccgtgtcttcccaggtttacaatcagagaatcacagctgctttaataaatgttatttataatacacggaaa

SEQ ID NO: 170091 - DNA, 1025 bp, Homo sapiens
  Payload ID: 13501
  Gene Symbol: PRSS57
  Gene Name: protease, serine, 57
  ENST ID: ENST00000329267
  CDS Start-End: 32-880
ctctgcggggagacgccagcctgcgtctgccatggggctcgggttgaggggctggggacgtcctctgctgactgtggccaccgccctgatgctgcccgtgaagccccccggctcctggggggcccagatcatcgggggccacgaggtgaccccccactccaggccctacatggcatccgtgcgcttcgggggccaacatcactgcggaggcttcctgctgcgagcccgctgggtggtctcggccgcccactgcttcagccacagagacctccgcactggcctggtggtgctgggcgcccacgtcctgagtactgcggagcccacccagcaggtgtttggcatcgatgctctcaccacacaccccgactaccaccccatgacccacgccaacgacatctgcctgctgcggctgaacggctctgctgtcctgggccctgcagtggggctgctgaggccgccagggagaagggccaggccccccacagcggggacacggtgccgggtggctggctggggcttcgtgtctgactttgaggagctgccgcctggactgatggaggccaaggtccgagtgctggacccggacgtctgcaacagctcctggaagggccacctgacacttaccatgctctgcacccgcagtggggacagccacagacggggcttctgctcggccgactccggagggcccctggtgtgcaggaaccgggctcacggcctcgtttccttctcgggcctctggtgcggcgaccccaagacccccgacgtgtacacgcaggtgtccgcctttgtggcctggatctgggacgtggttcggcggagcagtccccagcccggccccctgcctgggaccaccaggcccccaggagaagccgcctgagccacaaccttgcggcatgcaaatgagatggccgctccaggcctggaatgttccgtggctgggccccacgggaagcctgatgttcagggttggggtgggacgggcagcggtggggcacacccattccacatgcaaagggcagaag

SEQ ID NO: 170092 - DNA, 1090 bp, Homo sapiens
  Payload ID: 13501
  Gene Symbol: PRSS57
  Gene Name: protease, serine, 57
  Uniprot ID: Q6UWY2
  ENST ID: ENST00000613411
  CDS Start-End: 69-920
ggccgttggctgagggtgggagccacggcccgaagacctctgcggggagacgccagcctgcgtctgccatggggctcgggttgaggggctggggacgtcctctgctgactgtggccaccgccctgatgctgcccgtgaagccccccgcaggctcctggggggcccagatcatcgggggccacgaggtgaccccccactccaggccctacatggcatccgtgcgcttcgggggccaacatcactgcggaggcttcctgctgcgagcccgctgggtggtctcggccgcccactgcttcagccacagagacctccgcactggcctggtggtgctgggcgcccacgtcctgagtactgcggagcccacccagcaggtgtttggcatcgatgctctcaccacacaccccgactaccaccccatgacccacgccaacgacatctgcctgctgcggctgaacggctctgctgtcctgggccctgcagtggggctgctgaggccgccagggagaagggccaggccccccacagcggggacacggtgccgggtggctggctggggcttcgtgtctgactttgaggagctgccgcctggactgatggaggccaaggtccgagtgctggacccggacgtctgcaacagctcctggaagggccacctgacacttaccatgctctgcacccgcagtggggacagccacagacggggcttctgctcggccgactccggagggcccctggtgtgcaggaaccgggctcacggcctcgtttccttctcgggcctctggtgcggcgaccccaagacccccgacgtgtacacgcaggtgtccgcctttgtggcctggatctgggacgtggttcggcggagcagtccccagcccggccccctgcctgggaccaccaggcccccaggagaagccgcctgagccacaaccttgcggcatgcaaatgagatggccgctccaggcctggaatgttccgtggctgggccccacgggaagcctgatgttcagggttggggtgggacgggcagcggtggggcacacccattccacatgcaaagggcagaagcaaacccagtaaaatgttaactgac

SEQ ID NO: 170093 - DNA, 1123 bp, Homo sapiens
  Payload ID: 13502
  Gene Symbol: PRSS58
  Gene Name: protease, serine, 58
  Uniprot ID: Q8IYP2
  ENST ID: ENST00000552471
  CDS Start-End: 321-1046
cgtctgtagagatatcatgaacttcaacttagctttggtactttcttccctgaagacagagggcagaactctgagttccagaaccattttcaactgtattggggaccaatcacttgactctattcttgtctctctgacagatgacgctacactctcctctgaataatggacaccatttctaaaactgaatcctgctactaaaataattcagatgatatatttttccaattctacaatcttgctttgttttatttagttgttttctctctctcttcccagttttccagagactggagctaaactgggctttcaacatcatcatgaagtttatcctcctctgggctctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagctgatgttggcatctatgccaaaattttttactatataccctggattgaaaatgtaatccaaaataactgagctgtggcagttgtggaccatatgacacagcttgtccccatcgttcacctttagaattaaatataaattaactcctc

SEQ ID NO: 170094 - DNA, 913 bp, Homo sapiens
  Payload ID: 13502
  Gene Symbol: PRSS58
  Gene Name: protease, serine, 58
  Uniprot ID: Q8IYP2
  ENST ID: ENST00000547058
  CDS Start-End: 110-835
aaggctggcaaaaaggagaccagacaggaggcgtctgtagagatatcatgaacttcaacttagctttgttttccagagactggagctaaactgggctttcaacatcatcatgaagtttatcctcctctgggctctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagctgatgttggcatctatgccaaaattttttactatataccctggattgaaaatgtaatccaaaataactgagctgtggcagttgtggaccatatgacacagcttgtccccatcgttcacctttagaattaaatataaattaactcctca

SEQ ID NO: 170095 - DNA, 913 bp, Homo sapiens
  Payload ID: 13502
  Gene Symbol: PRSS58
  Gene Name: protease, serine, 58
  Uniprot ID: Q8IYP2
  ENST ID: ENST00000621886
  CDS Start-End: 110-835
aaggctggcaaaaaggagaccagacaggaggcgtctgtagagatatcatgaacttcaacttagctttgttttccagagactggagctaaactgggctttcaacatcatcatgaagtttatcctcctctgggctctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctca

SEQ ID NO: 170096 - DNA, 1123 bp, Homo sapiens
  Payload ID: 13502
  Gene Symbol: PRSS58
  Gene Name: protease, serine, 58
  Uniprot ID: Q8IYP2
  ENST ID: ENST00000622880
  CDS Start-End: 321-1046
cgtctgtagagatatcatgaacttcaacttagctttggtactttcttccctgaagacagagggcagaactctgagttccagaaccattttcaactgtattggggaccaatcacttgactctattcttgtctctctgacagatgacgctacactctcctctgaataatggacaccatttctaaaactgaatcctgctactaaaataattcagatgatatatttttccaattctacaatcttgctttgttttatttagttgttttctctctctcttcccagttttccagagactggagctaaactgggctttcaacatcatcatgaagtttatcctcctctgggctctcttgaatctgactgttgctttggcctttaatccagattacacagtcagctccactcccccttacttggtctatttgaaatctgactacttgccctgcgctggagtcctgatccacccgctttgggtgatcacagctgcacactgcaatttaccaaagcttcgggtgatattgggggttacaatcccagcagactctaatgaaaagcatctgcaagtgattggctatgagaagatgattcatcatccacacttctcagtcacttctattgatcatgacatcatgctaatcaagctgaaaacagaggctgaactcaatgactatgtgaaattagccaacctgccctaccaaactatctctgaaaataccatgtgctctgtctctacctggagctacaatgtgtgtgatatctacaaagagcccgattcactgcaaactgtgaacatctctgtaatctccaagcctcagtgtcgcgatgcctataaaacctacaacatcacggaaaatatgctgtgtgtgggcattgtgccaggaaggaggcagccctgcaaggaagtttctgctgccccggcaatctgcaatgggatgcttcaaggaatcctgtcttttgcggatggatgtgttttgagagccgatgttggcatctatgccaaaattttttactatataccctggattgaaaatgtaatccaaaataactgagctgtggcagttgtggaccatatgacacagcttgtccccatcgttcacctttagaattaaatataaattaactcctc

SEQ ID NO: 170097 - DNA, 1872 bp, Homo sapiens
  Payload ID: 13503
  Gene Symbol: PRSS8
  Gene Name: protease, serine, 8
  Uniprot ID: Q16651
  ENST ID: ENST00000317508
  CDS Start-End: 265-1296
aggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 170098 - DNA, 729 bp, Homo sapiens
  Payload ID: 13503
  Gene Symbol: PRSS8
  Gene Name: protease, serine, 8
  ENST ID: ENST00000567531
  CDS Start-End: 143-729
cttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaagga

SEQ ID NO: 170099 - DNA, 1214 bp, Homo sapiens
  Payload ID: 13503
  Gene Symbol: PRSS8
  Gene Name: protease, serine, 8
  Uniprot ID: Q16651
  ENST ID: ENST00000568261
  CDS Start-End: 230-1099
agacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgc

SEQ ID NO: 170100 - DNA, 552 bp, Homo sapiens
  Payload ID: 13503
  Gene Symbol: PRSS8
  Gene Name: protease, serine, 8
  ENST ID: ENST00000567797
  CDS Start-End: 230-552
agacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggt

SEQ ID NO: 170101 - DNA, 1083 bp, Homo sapiens
  Payload ID: 13504
  Gene Symbol: PRADC1
  Gene Name: protease-associated domain containing 1
  Uniprot ID: Q9BSG0
  ENST ID: ENST00000258083
  CDS Start-End: 69-635
gtcctgcgagcgacgcgcggcggggcggcgagaggaaacgcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgcaa

SEQ ID NO: 170102 - DNA, 4994 bp, Homo sapiens
  Payload ID: 13505
  Gene Symbol: PAAF1
  Gene Name: proteasomal ATPase-associated factor 1
  Uniprot ID: Q9BRP4
  ENST ID: ENST00000310571
  CDS Start-End: 54-1232
gactcacttccgggaaggggcggaagaggtgggctggtggaggcggggtcgagatggcggcgcctttgaggattcagagcgactgggcgcaagccctcaggaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaatatgaagaactttgttaaatactcttactccagcaaaaagttggtcaggacgatggaattccttcctcagcactccctgttgcctggccatagagaaggcctgcttggcagtagcaataaatgtcctgtaagctgccacctgggagagattcttatgcaggtggtaaccaactgtcccagtttgcttggaactaaggggttttctgtgacttgaaactttcaatgccaaaactggggcagtctcaaaccaacatgattggtcagcctatatgtaggtgaggaaactgaatcataagcattgtaaaggcattggctgtcaaagtgtggttcttagaacagcagcatcagtatcacctgggaacttgacaggaaatagaaattgttaggcccaatcctagacctaaatcagaaattctacgggtgcagccagcagtctgtattttaacaagcattccaggtgattctgatgtatgctaaagcttgagagccactgatctagaggaagagatggtggagggcactttagtcacagctggaacccagggctcaaaatgacaagatcggtctgtaggagatgaggccacagaggttggcagagcccaaatagtgaaggagcacgaatgttagctaaggagctcagactttacgtggttggcagtggggaaccactgaagggttttaagcaagagaatggcatggtcacctccttttttctctaaacataaaaatggaatcataatgtatgtattccatggcttattttcacttaatgtctctgagattttccatctcagtacatgtagacgttcctcattcttttttaacaatgtccagaatatggataccatattatttatatttttgagattattagagaaaagtttcttgaaagatgtaacacttgagctgggacatgcagattaagatttttatttatttaacggaggaaggtcatttctggctggggtaataatgttgttgacagagttcttttttttgttttttttgagacggagtctcgctctgtcacccagactggtgcgatcttggctcactgcaacctccacctctcaggttcaaacgattctcctgcctcagcctccctagtagctgggactgcaggcatgcaccaccatgcccggctaatattttttttgtatttttattagagatggggtttcaccatgttggccaggctggtctcgaactcctgaccttgtgatccacctgccttggcctcccaaagtgctgggattacaggtgtgagccaccgtacccggccggccaccagagtttttaaaggcgtattctcatgtaaattttttttttttaaagacagggtcttgctctgttgcccaggctggaatgcgttggcatgattacagcttctgccttaacctcctgggctcaagcaatcctcccacttcagcctcccaagtagctgaaaccatgggtgcacaccaccacactcggctaattttttaaattttttgtagagacagagtctcaccatgttgcccaggctggtctcaaactcctgaactcaagtattcctcccaccttggcctctcatagtgctggcattacaggcatgagccacggcactcaaccaggaactttgtcttaactttaaatcccatttttttctacaacaccctgttacttaaaccaaagtgtaaaaagaaaatactgcaattcatttaatatctactctgttctagatactatatttatatatctaattcttacaagactcaaaaagcgaatgttattatttgttttattccgataaggaaactgagactcaatacattaaataccagaggcttcatttggaccttggacagcaccttctgctgcactgtgtaatcacaggcaggtagcaagagacttttgtgactagagcaatttcatttcaaggtgcagtttgtgacagggtcaggtagaccagaatggacatattccagaacttagaaacattaaatcctaggagctccaggtggaacatctaagaagtcagattaagaaaacaggatgaggctgggcatggtggctcacgcctataatcccagcactttgggaggccaagacgggtggatcacctgaggtcaggagttcgagaccagcctgaccaacatggagaaaccccgtctctactaaaaatacagaattagccgggcatgatggcgcatgtctgtaatcccagctacttgggaggctgaggcaggagaatcacttgatcccgggaggcagaggttgtggtgggctgagattgcgccattgcgctccagcctgggcaacaagagtgaaactccgtctcaaaaaaaaaaaaaaagaaaacaggatgaaatgggccgggcgcagtggctcacgcctgtaatcccagcactttgggaggccgaggcgggcggatcacaaggtaaggagattgagaccatcctggctaacacagtgaaaccctgtctacaaaaaatacaaaaaaatttagccaggcatggtggcaggcacctatagtcccagctacttgggaggctgaggcaggagaatggtgtgaacctggcaggcagagcttgcagtaagctgagatcgggccacagcactccagcctgggcgacagagcgaggctctatctcaagaaaaaaaaaaagaaaaaaagaaaacaggaagaaatgttgtcatttatttgtagaatctgaaacatttgaactcatagaagcagtgagtggaagaaccagcgtggtggctcacgcctgtaatcccagcactttgggaggctggggtgggtggatcgctggagcccaggaattggagaccagcctgcacaacatgaggaaactctgtctctactaaaaatacaaaacttagccaggtgtggtggtgggcacctgtaataccagctactaaggagactgaggcaggagaattgcttgaacccaggaggtggagggtgtagtgagctgagattgcaccactgcactccagcttgggcaacagagcgagactctctctcaaaaaagaaaaaaaaaatatgtatatatatatgtatatatatatatttatatatgtagaagcagtgagtagaatggtggttacagagactcggggaggaggaatggggaaatgatggtcatagggtgcaaagtctcaggaggaatatattgtgttttgagatctattgcatagcatggtagattgctaagagtaaatttcaaatgttctcaacccaaaaaatgttaagcatttgaggtgatggatatgttaactggcttcatttaattattccatattgtatttataagtcacaataggactttgtggcccataattataaacaagtataaattgtccatttacaattaaaaatcaattaaaagaaaagaggataagg

SEQ ID NO: 170103 - DNA, 1500 bp, Homo sapiens
  Payload ID: 13505
  Gene Symbol: PAAF1
  Gene Name: proteasomal ATPase-associated factor 1
  Uniprot ID: Q9BRP4
  ENST ID: ENST00000376384
  CDS Start-End: 1-1128
atgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctg

SEQ ID NO: 170104 - DNA, 1802 bp, Homo sapiens
  Payload ID: 13505
  Gene Symbol: PAAF1
  Gene Name: proteasomal ATPase-associated factor 1
  ENST ID: ENST00000544909
  CDS Start-End: 258-1439
gtgtgattttggacaaataacttagttctctgagtctcagtttcctcatcaataaagctgagatcctattctacctcctagaatggttaatggggaatgagactgcatgtggatgaatctataaaatactacagaagttagttttggttcttttaccataacaatcctgtgggattggcattttaaatttccattttgcagataagcaaaccaactcagagaggttaattaatctcaaataatcaaagacagactgtatgctggaattgaaacccagttctgttgattccaagtttagcactaccatgcaagcctacgtttttcccaggtgttttggcacagcctgggtgctgacttctttcttcccttcatactcagacctggatacagtctttatcacttcaaacatgattgctaatttttgctgtgaacctgctgagtgggttcagacaaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttgg

SEQ ID NO: 170105 - DNA, 1639 bp, Homo sapiens
  Payload ID: 13505
  Gene Symbol: PAAF1
  Gene Name: proteasomal ATPase-associated factor 1
  Uniprot ID: Q9BRP4
  ENST ID: ENST00000536003
  CDS Start-End: 146-1273
gtgggctggtggaggcggggtcgagatggcggcgcctttgaggattcagagcgactgggcgcaagccctcaggaaggatgaaggggaggcctggctgagctgtcatcccccagtggaagcagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggagg

SEQ ID NO: 170106 - DNA, 1695 bp, Homo sapiens
  Payload ID: 13505
  Gene Symbol: PAAF1
  Gene Name: proteasomal ATPase-associated factor 1
  Uniprot ID: Q9BRP4
  ENST ID: ENST00000535604
  CDS Start-End: 611-1444
aggtgggctggtggaggcggggtcgagatggcggcgcctttgaggattcagagcgactgggcgcaagccctcaggtgaatccaggcccagaacagagtcagaggaggcgggtagtggatgttgctttgcgtcaaggagagccatgcctggtccaggatatcaataggggttacttcgtcaattgtcgagggatatggagggaacagggtccggaaaaagaagtatcaaacccgtatggtcattctctgaaaagctatccctaggccaagggagcacatgagctgtgtgatccccgcgtcagaactagtatcagaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacaca

SEQ ID NO: 170107 - DNA, 882 bp, Homo sapiens
  Payload ID: 13505
  Gene Symbol: PAAF1
  Gene Name: proteasomal ATPase-associated factor 1
  ENST ID: ENST00000543814
  CDS Start-End: 142-882
aagaggtgggctggtggaggcggggtcgagatggcggcgcctttgaggattcagagcgactgggcgcaagccctcaggaaggatgaaggggaggcctggctgagctgtcatcccccagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcag

SEQ ID NO: 170108 - DNA, 667 bp, Homo sapiens
  Payload ID: 13505
  Gene Symbol: PAAF1
  Gene Name: proteasomal ATPase-associated factor 1
  ENST ID: ENST00000542293
  CDS Start-End: 367-667
gtgggctggtggaggcggggtcgagatggcggcgcctttgaggattcagagcgactgggcgcaagccctcaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcag

SEQ ID NO: 170109 - DNA, 975 bp, Homo sapiens
  Payload ID: 13505
  Gene Symbol: PAAF1
  Gene Name: proteasomal ATPase-associated factor 1
  ENST ID: ENST00000504441
  CDS Start-End: 265-975
gggaaggggcggaagaggtgggctggtggaggcggggtcgagatggcggcgcctttgaggattcagagcgactgggcgcaagccctcaggaaggatgaaggggaggcctggctgagctgtcatcccccagctgattgttaaaaagatcctggcatctcccttctctctcttacttcctctctcaccatgtgatctctgcatacactggctccccttctccttctgccatgagtggaagcagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctg

SEQ ID NO: 170110 - DNA, 805 bp, Homo sapiens
  Payload ID: 13505
  Gene Symbol: PAAF1
  Gene Name: proteasomal ATPase-associated factor 1
  ENST ID: ENST00000546039
  CDS Start-End: 323-805
aggaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcagggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctggg

SEQ ID NO: 170111 - DNA, 1383 bp, Homo sapiens
  Payload ID: 13505
  Gene Symbol: PAAF1
  Gene Name: proteasomal ATPase-associated factor 1
  Uniprot ID: Q9BRP4
  ENST ID: ENST00000541951
  CDS Start-End: 342-1175
gatcgcagccccgttgtgcccgcaacgcctcctgaagaacgcggaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgca

SEQ ID NO: 170112 - DNA, 1612 bp, Homo sapiens
  Payload ID: 13505
  Gene Symbol: PAAF1
  Gene Name: proteasomal ATPase-associated factor 1
  Uniprot ID: Q9BRP4
  ENST ID: ENST00000544552
  CDS Start-End: 102-1229
gcgcctttgaggattcagagcgactgggcgcaagccctcaggatgaaggggaggcctggctgagctgtcatcccccagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaatatgaagaa

SEQ ID NO: 170113 - DNA, 349 bp, Homo sapiens
  Payload ID: 13505
  Gene Symbol: PAAF1
  Gene Name: proteasomal ATPase-associated factor 1
  ENST ID: ENST00000540659
  CDS Start-End: 1-349
atggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgttcctctttattggctcagacgctttcaactgctgtacttttctctctggcttcttgctattggctgggactcaagatggaaacatttatcagctgga

SEQ ID NO: 170114 - DNA, 582 bp, Homo sapiens
  Payload ID: 13505
  Gene Symbol: PAAF1
  Gene Name: proteasomal ATPase-associated factor 1
  ENST ID: ENST00000536582
  CDS Start-End: 132-582
acttcacctgacttttaacacaggcacctgtttttctttcgtgggccaatttcatgggtatactatttatacagatgcctgaattgggtcttcaaagagaaaaataataaatttttcttattttttgagacatgcttcttttgtaccatatagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttca

SEQ ID NO: 170115 - DNA, 2154 bp, Homo sapiens
  Payload ID: 13506
  Gene Symbol: PSMG1
  Gene Name: proteasome (prosome, macropain) assembly chaperone 1
  Uniprot ID: O95456
  ENST ID: ENST00000331573
  CDS Start-End: 467-1333
ccacctcctggcgcccgcagggctcaagctgcgaatgaaagcctttgggggccggacgcggtggctgaggcctgtaatccaagcactttgggaggtctaaggaggacgatcgctagagtcctggagttcgagaccagtctgggcaacatagcgagaccccctcccccaatctgtaatttaaaaacaaaaaagctgcggggactgctggcccagggcatgacagcgcgggcgggcggtgtagagggcgtggccgcgagctcagggtgtgcctgggagcgagccctgtgcggggcgggacgtagcgcccgcgcggtgggggtgtggccgcgagcttgggctgtgcgcggagggcgtggcctgtgcggggcgggacttattgcccgcgcggtgagggagcgtggtctcgcgcaagccggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaattaattgtagttttaattccttatttatggtggtattattcacaaccaaaataagccaagcattttccttttatccactaggtgggagtattgttgtatttgaatattttaaggtactatagttaaatttttatcttatttatttatttatttattttttgaggctgggtcttgctctgttgcccaggctgaagtgcagtgtgctatcatggttcactgcatcctcgacctcctgggctcaagcatttcccccgcctcggcctcccaaaatgctgggattacaggtgtgagccactgtgcccaactttagttaaatttttcaaagctacagatatcagcagatggtattcatgtggcaaagtgtagttaattaggtgtaactattcattgacctgttggtgattcttaatatgtggaaagtttctggatattttaggagtcctgcagttttttttatcttgtgggtaaaaattgatgacaaagtaacaaaattatatatttactaaaaatgaaacagaaatgtgtatgtcctcactttttagtaatatctgacagatagcctcttcacccagactttcccagggctctctttcaaggctggctctgcgcgtgtcagcagttctcttacagtcatgtgttatcattaggagtgtgaatggaatcatgaacccggagtagccacacaacttcaca

SEQ ID NO: 170116 - DNA, 907 bp, Homo sapiens
  Payload ID: 13506
  Gene Symbol: PSMG1
  Gene Name: proteasome (prosome, macropain) assembly chaperone 1
  Uniprot ID: O95456
  ENST ID: ENST00000380900
  CDS Start-End: 104-907
ggggcgggacttattgcccgcgcggtgagggagcgtggtctcgcgcaagccggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatga

SEQ ID NO: 170117 - DNA, 760 bp, Homo sapiens
  Payload ID: 13506
  Gene Symbol: PSMG1
  Gene Name: proteasome (prosome, macropain) assembly chaperone 1
  ENST ID: ENST00000431628
  CDS Start-End: 1-192
atggcggccacgttcttcggagaggtggtgaaggcgccgtgccgagctgggactgaggacgaagaggaggaggaggaggggcggagggagacgcccgaggacagggaggtgcgtctgcagctggcgcggaagagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatga

SEQ ID NO: 170118 - DNA, 959 bp, Homo sapiens
  Payload ID: 13506
  Gene Symbol: PSMG1
  Gene Name: proteasome (prosome, macropain) assembly chaperone 1
  ENST ID: ENST00000411828
  CDS Start-End: 1-40
ggacagggaggtgcgtctgcagctggcgcggaagaggtgaggcaccgggataagggcagcgcgctcaccgcagctggaaggtgcgcgggcctggcagccgcgacggcgcctaaggccggggctccgcggtcttccgagtggcccccgcggttgccgccgctccttggctctgcttgggccctgggtctccgtgaagccgcggcgtccagcggcgccagccccagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatc

SEQ ID NO: 170119 - DNA, 1686 bp, Homo sapiens
  Payload ID: 13507
  Gene Symbol: PSMG2
  Gene Name: proteasome (prosome, macropain) assembly chaperone 2
  Uniprot ID: Q969U7
  ENST ID: ENST00000317615
  CDS Start-End: 683-1477
ggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccggccgggccagggagcgttaggagcgactggagcacaaagcgccgcagccgttcgcctagcgcagctcccgggggacgcaacgccgcgtcaggccgggggctgacctggaaatgaggccccggcggcggcggcgccaactgttttcaaacagtggcggacaaacagggcttggggctggcccgcacgctgcctgatcgtttccgcccgccgctccacctccccgcgggccccgcaccccgagacctcagcgcaccccatcgccttgcttgccagggtctccgaaagcgctgctggcccctcttcgcggccacccggcggcctctttccgccctctgaaccggcagttagctggacgggcctcaagggcccggcgcccagggactcaaaggaccctcccgcgccccgcgaggctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 170120 - DNA, 1036 bp, Homo sapiens
  Payload ID: 13507
  Gene Symbol: PSMG2
  Gene Name: proteasome (prosome, macropain) assembly chaperone 2
  ENST ID: ENST00000590217
  CDS Start-End: 86-808
tccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttgtaagttctattatagcttaagcctcttctttgtctggttgtattcattaactcgcactttatatactacctaagtagaccaagtaagtgaacgtttgtattaaatatagacatatctttacataaaatttagtttaagctgaacttttgaaaattagaggacagttaaccaacctattatttacagttttttcattaaagctgactttccaaaaaggaaaatccttagttcttcattgtacttactat

SEQ ID NO: 170121 - DNA, 711 bp, Homo sapiens
  Payload ID: 13507
  Gene Symbol: PSMG2
  Gene Name: proteasome (prosome, macropain) assembly chaperone 2
  ENST ID: ENST00000586587
  CDS Start-End: 83-379
ggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaa

SEQ ID NO: 170122 - DNA, 983 bp, Homo sapiens
  Payload ID: 13507
  Gene Symbol: PSMG2
  Gene Name: proteasome (prosome, macropain) assembly chaperone 2
  Uniprot ID: Q969U7
  ENST ID: ENST00000585331
  CDS Start-End: 73-774
tggttgaatacctccctctccactcccatcttcaggccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 170123 - DNA, 646 bp, Homo sapiens
  Payload ID: 13507
  Gene Symbol: PSMG2
  Gene Name: proteasome (prosome, macropain) assembly chaperone 2
  ENST ID: ENST00000586445
  CDS Start-End: 20-646
ctgaggagctacagctattatgcaacagagccaggttcaagctctgagctgttttactccaaaggctgtggcaataagaactcctctgagaaatgtgtggccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatg

SEQ ID NO: 170124 - DNA, 1007 bp, Homo sapiens
  Payload ID: 13508
  Gene Symbol: PSMG3
  Gene Name: proteasome (prosome, macropain) assembly chaperone 3
  Uniprot ID: Q9BT73
  ENST ID: ENST00000252329
  CDS Start-End: 554-922
cccagcactttgggaggccgaggaaggcagatcacctgaggtcaggagttcaagaccagcctgaccgacatggtgaaaccccatctctactaaaaatttaaaaagttagccgggcctggtggcgcacgcctgtaatcccagctacacaggaggctgaggcaggagaattgcttgaaccagggaggcggaggctgcagtgagccgagatcgcgccactgcactccagcctgggtgacacagcaagactccgtctcaaacaaaacaaaacaaaaaaccttccagcttggagaaactgagagtgagcagtagggagtgagggggtccctgggaggaaccagaactcatcccgcttcagggtggggctggcccccttcttggccttggccggggcttcgtgtcacggagcgcccgagggacggtcggagcccaccccagcccgcccgccgcctgagcctggccgagctctctgcacctgcacacgtctgtaaaacgcggatgaaacgcttctacggaaccgggtggctgagatgaactgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccc

SEQ ID NO: 170125 - DNA, 1391 bp, Homo sapiens
  Payload ID: 13508
  Gene Symbol: PSMG3
  Gene Name: proteasome (prosome, macropain) assembly chaperone 3
  Uniprot ID: Q9BT73
  ENST ID: ENST00000288607
  CDS Start-End: 655-1023
cgcgggcttccccgggcggctgcgtccccagtagcccggccggcctcggcaccgcgtgtcgtgggggtcccgggccgcggctgcagggccggggcggcggcgaggccgaggggcgggaagccactgcccggcctggcagtgtgaacgtgcaagtcgatcccctaacccagaaagccccaggcgcggtctctatgggcggccccgctcctgcttctgttttatttttttacggacagggtctcgctctaccgcccgggttgtaatgcaatggtgtgatcacggctcaccgcagcctcgacctcccgggctgaagcgatcttcccgcctcagcctcctgagtaactgggaccacaggcgcgccctgctggttttttttttttttttttttggtagagatgggggtctcgctatgttggccaggctggtctcgaattcctggcctcaacgatcgtcctgtctcggcctcccaaagtgccgggatgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaagcgaatgtgtatcccaaaata

SEQ ID NO: 170126 - DNA, 774 bp, Homo sapiens
  Payload ID: 13508
  Gene Symbol: PSMG3
  Gene Name: proteasome (prosome, macropain) assembly chaperone 3
  Uniprot ID: Q9BT73
  ENST ID: ENST00000404674
  CDS Start-End: 59-427
cgcacgcagagccacttccgggcgcggcgccggcttgctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgaaggcgctgagggaggtgatccgggtgtgccaggtgtggtgacctggaggcagccgccccgcgctgctcagcaggacacgtgaacacccagacacccactcagggactcaagtctcacctccctccccggtggagggaggaactttggcactagcccttggagccaggaaaaaagactcgtgtctcaggcagactcttactctggttactaagatcatctgtgcatgacggggagggtggaacaggtcccggaggagtcgtgaatggttctcaccaggacctgaatcgttgcttgtgtttgagaattggaggaatgagtcagcaggcgtggctcatggcccccccgtgtgcaggatcaattgtaggaggaaatttcttttttattaaaa

SEQ ID NO: 170127 - DNA, 489 bp, Homo sapiens
  Payload ID: 13509
  Gene Symbol: PSMG4
  Gene Name: proteasome (prosome, macropain) assembly chaperone 4
  ENST ID: ENST00000380305
  CDS Start-End: 127-375
cccgcccttccggggccgaaagcgaaagcgcgctcggtctctcggtgctcgctccatcgggtctggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaattt

SEQ ID NO: 170128 - DNA, 726 bp, Homo sapiens
  Payload ID: 13509
  Gene Symbol: PSMG4
  Gene Name: proteasome (prosome, macropain) assembly chaperone 4
  ENST ID: ENST00000380306
  CDS Start-End: 283-657
cagggaatgcacgctgagtcctagacacagagccaggccgggtggaaaacaaaaagagaagaagtgattatgaaataataagacggaccgtgtgccccttgcaaggtgcggcctgcgaaatcaacagacttataaataaggtctggtggaagcgcaggagcgcacgcgggaggctatggcgggggaacctctgtgagttccgcggcggaggctagaacatcgctgtggctgcgggaccctcacccggcgctgaaaaccctccacatcagctcctgctcggaaatgtctccgcagctcaccagtgcttttcgaaatctgcccaagacctttgtttgccatttaaatgaaatgaaaacgaacaaacacacttggaatatgcttctattcctaagaagttggctgcataggagcacaacatcaccagcttaccacgtattggtcattctctttgaggagcagggccatactgacggcttacatgtgcgctctggtggaagtaggatgtttggtggcagcaggagcaaaatcaactctgccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttca

SEQ ID NO: 170129 - DNA, 629 bp, Homo sapiens
  Payload ID: 13509
  Gene Symbol: PSMG4
  Gene Name: proteasome (prosome, macropain) assembly chaperone 4
  Uniprot ID: Q5JS54
  ENST ID: ENST00000419065
  CDS Start-End: 72-560
atcgggtctggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctagggctcggagggaagactggcctggcctgtgagtgtggcgtagagtggggattaagcaaaggtcatgaggctgaatgctccactcttcccacaccccaacacacttcctgtgggccagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttca

SEQ ID NO: 170130 - DNA, 824 bp, Homo sapiens
  Payload ID: 13509
  Gene Symbol: PSMG4
  Gene Name: proteasome (prosome, macropain) assembly chaperone 4
  ENST ID: ENST00000451246
  CDS Start-End: 40-270
cccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacacagggagtgagcctgcggtcggcctgaggtatcctgcaactgcaagcactaaataagctcctgactcatctctcccctgtggctgatgcagaagctgatcctggagaaactaaaaccttctgcacagcaaaggaaacaatcaacagactgaaaagacaacctacagaatgagagaaagtctttgcaaactattcatctgacaggggattaacatctagaatatatgaggaactcaaacacctcaacagcaaaaaaagaaacaacctgatttttaaaatggacaataatctgaatagacatttcttaaaagacacaaatggccaacaaacatatattaaaaaaagctcaacatcactaatcatcagaaaacacaaatcaaaaccacaatgaggtatcaactcacctcagttaggatggctattatcaaaaagacacacacacaaaaatgctggcaaggatgtggagaaagggaactcttatatgatgttggtgggaatgtaaactagtacatcaactatggagaacagtacagaggttcctcaaaaaactacaaacagaattacctcatgacccagcaatcccactactggtgtttatccaaaggaaagga

SEQ ID NO: 170131 - DNA, 838 bp, Homo sapiens
  Payload ID: 13509
  Gene Symbol: PSMG4
  Gene Name: proteasome (prosome, macropain) assembly chaperone 4
  Uniprot ID: Q5JS54
  ENST ID: ENST00000438998
  CDS Start-End: 130-501
acccccgcccttccggggccgaaagcgaaagcgcgctcggtctctcggtgctcgctccatcgggtctggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtgacgtgcatcctcaattagaattaaagtgatgtataaatatg

SEQ ID NO: 170132 - DNA, 2323 bp, Homo sapiens
  Payload ID: 13509
  Gene Symbol: PSMG4
  Gene Name: proteasome (prosome, macropain) assembly chaperone 4
  ENST ID: ENST00000454610
  CDS Start-End: 1-353
ccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgttccgtgtccccaccaccttcacgatgcagaccttcttgggcctccgggaaagctctttctccagctctgcaaagaaacagaccctgtgagccctgggcaggccgcccacagaggacaggacagcagctgcagtcacagccctggttccccagttcgggtaccacagaagggagagagaagctttttttttttttttttttttgccagtggatagggtctaggtttccaggatagaaaggcactcataagaccccagctttgcagttcaggtttcgctcgggtgcctgagagggcaccaaggtgcaccgtcagcagaagtttccatcacaaacccttgttttggaaccagtcagagtgcacacaaacggtctcgactcagttcacttttgtctgagtacagagctcagcgatgatattctaggttactgaggcactcattaggccctgggcaaatctaaacatgcagttcttttccgtacactctacatctgcctgtgtcacccccggctcggagactgggaaggccacatgcagatatgcttcttagccttgtggggtggaactatggctgtagctacttctgctgaaactgcccttaggacatcatatgcatctttgaaagccaaatacataagtgaacacatctgcgtgtatgtgtatacaccatacatgcacacattcatacgcatgcatatacgtgtgcatgttttagttaacagaagtccttgggggctggacaatattttggctccaagggatgtgagcaactataaagtcatgagactgagtttcttgtgcggctccagcggctctgaaagcccctctgaagggagtccaccagcgcacagtgttacattcaccaggccaaggggtctgcagaggtgctggtgttgatctggcaatttacagggaagattcagaatggtgggggtgctggcctccaggagctgtctgcttgcacgtctgggagcaggaatgccacctcagccttctgttgcctctctgccttcctagcctggcatgtcttcatggagtaatcccctactggggagctaaaaaagaaaagggagacttcccgaagcggaggggaaccaggactcttcaagactgtcaaggtcaccagaaacaagaaagactgagcagctgtcagaccaggagactagggagaggggaggacaagacgcagtcctgggcggcatcccgggtgggaggagtcgtcatggaaagcacgatgatgggaggcaccaaataaaggctggggtttggtgaatggtagtgttccaatgtcactcttttagtttcgacaacagtaccacgacagtatcagacattcgcaatctgggaagtcgagtactgggaggtctgtcgttgcctctagagggatccttctgctccctcgggggctgtgtctccaggaccctggccctgtgcttccgagggccactctgaaccctggatggctcaagttcaaccctcctcttccacctccttcctgccatccagcggtaggagggtcacaaagctctttcattatagtttgaagaaaaaatgtgttgctaaaccgtagggatttgaataaagcaatgatgtttttattcaaacattgtttttgaactgagtgtcaccagccagggcacagaagggagaaggagaaacctttcacttgtctgagggagctcatgtctactgagtttccagaactttctcccttgccatacttgggtgcaaagattgaggtctgtgtgtaagcccacagggccggcgtttcagctgctggtccacggaccctctcagctcccaaggtccattatttttcctcagcaaaaatgggctactttgactacaggcacagtttctccatggttaaaataactaattttataaagagcttgaaaatatcatggttaacagaaaaccttggatccaatgatctgaatatctttgctattatagaactcatcagaaaccaactgtaatagctacgttttctcaccatggaagacttccgagaagaaaatttcaatgtccattagcaagtccatataagtttaaagttttaaaaagtatataccccaaactgaactcctgatatgttattgtttactaagtatgatgttaaagaagcaataacaactgcattatgacctgagctttttaaataaaattaaacctagaacccagtct

SEQ ID NO: 170133 - DNA, 4603 bp, Homo sapiens
  Payload ID: 13509
  Gene Symbol: PSMG4
  Gene Name: proteasome (prosome, macropain) assembly chaperone 4
  Uniprot ID: Q5JS54
  ENST ID: ENST00000473000
  CDS Start-End: 63-377
ggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctaggtatgtacccacagctggcgctgcatggccagccaggtggggcccactctttaatggaaccatgaagcaagtcccttcggaagtaaagcatctttatgctaagaaccatcacctcattgctgctgggaagcacagacctttgcacgttgggtcttatttaaggggcacattccatgctcgcctgtcatcaccaccgtcccagggctggcctgttcccaaaggactcccacctcgtccttgggtgtgtccttgagtccatgagctgatttagttgccttccgtaagtgcatcaccacctcctgggaggagagcatgagaagtgcccacagcccctgtgggtggtggctcaaggtagcctcccgggccttaggaggagtcagtgcagctggtggagcaggtgtcacctctgtgcaggaaggactgtcctcactcagtgtgataccgttcagggctcggagggaagactggcctggcctgtgagtgtggcgtagagtggggattaagcaaaggtcatgaggctgaatgctccactcttcccacaccccaacacacttcctgtgggccaggtaaggcttccatgtgctctgcgacccccagccccagtgcctgtggccagtgtgcacaggatgcctgtctcctgcccaggcctggcgttctccagtaggcccagctgcttctgctctggagtcttctctgtgtctcaggcacaggacctggtacctgacaagcaggaacctctgtgtcagtcacactgaggcaaatgcacacgaatagcatggcacctggcccagggggaaggcagggcagggtggagtgtcaccagcaggcccatgacagtatgtggataggacagaggtcagggagggcacaggtcagcatttcaggaactcgcagtattctttttccctcccttggaggtggggacctgacttgtaagttaatttggtaatttttaactaggaagtaaatttaaaatttacagaaaagttgcaaagaagatagaattcctgcttagcttttgccccaatttcccacttgccacccttccctctttgtgtttgtatctttttttttctgagccacatgaaagtaaagctgccttttgtgtctgtgtcactctgtgtgtgtgactgtgtaaggggtagcacacttacatggaacaggttactgcgtgtgggagaaggctcaggaaggtattcatatttatacagacggaaagctgggtggggttgcggacacactcccatagagaaggtggtgtgagcttgtctggcaggccgtgaataactttcatatcaataaggtaaattagtctccagaatatttgcgagatggaggcctagtatctatatgcaaaaaagaggggttctcagtatctcgactgtctcaacaagtcacgggtgtgccgtggcttccggcgtctcttaagggaatggtgctgcagagctcggaccaagaaggttttccagcaaagtcccatgctttgccagttgccttgagcctgggtctgggccctcaagttgaaaatgcactataatgaaaagggagaggtgtcctgaatcagtatcttatatgagagatgaaagcaggtagggaaagagaaggcctggggggttctcagtagctctggaagcatcgcaggagttggtgtggccaaggggacccaacctcctatggccctggaggggcacagcttgggtctgaggggctcagtgcctccagacacagcgttgttcctcagaaatcctgtctctgcagttagaacagttggaataccaggggggcccccttagggtaaagggggatgttcctgcccctgggatatagggcagggtgtgacttacaggctcctcctaggcagccttggtgagccccagcttcctaccacactgcctgcctttagatcaccctctacatgagtggtcccagcctgcctaacacagctaggaaaggatgaggttggtccctaatggtgggggaagcctaagaggcttcctcactccccgcagggctgagcagataactgggcacaactctccgcctcgggggcacactgcacccagcacactggtgggaggctctgtgctaagtactgtaagctgttctttaaacaccagctcttggaataaccgaacagctgcctttgtccggacacattcctttttttttttttttaataaaaaaacagctttaccgagacgtaaacacatgtcatacaattcagcagctgtcctcaggcagaggctgtgcttgccgccgccttgctttttcataggtgtgttggctgctttgtaaggacagtcagtgagttaatacccaagacctttccagccctaaaaatcacgcagccttgtacagcggaaaaacaggcttttggggtcctgggctctccctctcctcaatttccaaacaaagctgggagaggtttccaggccacggtggggcctgggcctgcgcctgcacctgcgcccctgagccacactgcctctcagggttcttggtgggaccatagctcagatggcagcaactgaaaggacagaactgctgcccagatgagatcccatgacgtgtgttctaaatcggcctttagtaatggtgcaggtggcctggtgccctcagcctcaccgcaccacccttttgccttttggtgatgaggctaagtacatgcttgccatatgttgaggtgggggtgggtcagtgcctctccaggggtgagtagttctgcactggccctgcgtatgggtgaggctaaaggaggaggccgcgcagtggggcaggcaacatccaactgctttagcctttttgcccacgtattttcaggatattggctttcagattccaggtgtatgactctgcttgatttttgcagttggcccaatgtgcacctcagccattttctattgattctgtagaaggggactaaaacttacattcagtagaaaattacgtgtgtgtccatatgcctatctgtgcacacacacacaaatatatttgtgtgtatacacatatatgcaaatgcatggaaacgtaggagggagggaagtggaactggttggggtggggtggtgctgaaggagaactttaatattttattttaaatacttatttttttttgagacggagtcttgctctattgcccaggctggagtgcagtggcgcgatcttggctcactgcaagctccgcctcccgggttcacgccattctcctgcctcagcctcccgagtagctgggactacaggcgcccgccaccatgcccggctaattttttgtatttttagtagagacggggtttcaacgtgttagccaggatggtctcgatctcctgaccttatgatccacccgtctcggcctcccaaagtgctgggattatgggcgtgagccaccgctcccggccattttttgtgtttaaatttttttttttttttttaaatcaaaacaccagaaacccctctgtgtagggcagaggttcttaagcagtgcggggcacctgcaggatctgttccagcagacagctggccccaaatcctggctttctgggtcaggagggctgggtggggcccagcagctgcctctcgaacaagttccagggaggctgctgaggtggggcctgcccttcagaaccctgggtctggtggagagactgggagaggcctgagtgactcgtctgcatttgcagcacctgtctgaagagaggcatggagattagagctttcttttctccctacaaccccatcctctttctgagcatttcccagctgcacgtggctgtgaggaacacggggcctgcagtatttcaggagtggctgtatcaatgtgttttctctttttagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtgacgtgcatcctcaattagaattaaagtgatgtataaatatgc

SEQ ID NO: 170134 - DNA, 2241 bp, Homo sapiens
  Payload ID: 13509
  Gene Symbol: PSMG4
  Gene Name: proteasome (prosome, macropain) assembly chaperone 4
  ENST ID: ENST00000509933
  CDS Start-End: 687-794
gtttagtcgcaggggctgcggggtggcagcctcagagccctgtccttccgcagccgtgggccccgcagggaccagccaagcagggcaaccaaaagctggaaccagcagcgaaaaccccgagcccacgaacgcagcgcagtgcgggaacacttgccctttgttcctcagtaaggccgggtgttttcgcatccccggaggttgtgaatttgagttataatggcctcggtcgggactgagagagccgagcttccacgagagagctttgcctgctttgtcctacaaatcggcggagggagtagcatcctggcttttctagggcgccatttccctgctacaggcaatctcccctcccccacgctgtcaatgatttgtgggattcttaggcaggcggggcaggccgagcccagggaatgcacgctgagtcctagacacagagccaggccgggtggaaaacaaaaagagaagaagtgattatgaaataataagacggaccgtgtgccccttgcaaggtgcggcctgcgaaatcaacagacttataaataaggtctggtggaagcgcaggagcgcacgcgggaggctatggcgggggaacctctgtgagttccgcggcggaggctagaacatcgctgtggctgcgggaccctcacccggcgctgaaaaccctccacatcagctcctgctcggaaatgtctccgcagctcaccagtgcttttcgaaatctgcccaagacctttgtttgccatttaaatgaaatgaaaacgttcccttccactctgctccaagaatttccatgatgaagagagctggctggagggcaggattcaggtggtgacttactcattcttcagcctcagataggctttgctccaagcgcagggcagcacctgggaggctgtgggagctctttcagtcagcaagtaggtacaacagatgcgacaccatgcagacacgcagctgtgaacgacagttcagaactcagcgtaagcttgtgctatgaacgagcaccgtcagagaattcccacccacacgtacagaaacacagtttttatattacaacctcaaggacagggagggaagtgttcgccgctagacatgacacaccatactgcttttccaaaacacacgggacatgaaagcgaggtggtgccttctagacgagaggacagctgtagtgtggacctcccccgcacatgcgatacctcgggccgggcggtgtgacctcacaggcccacttatggcacttgcagtttgggattgctcatttggctctaggaagcggtggtgtctgagtgtgatacttcccttacgaggtttgtttttgttttctttctgttctgtagccaaaccaatttaccagcccgtcttccagatgcaggtgatcttactctcagtaaacaaaaacatgtaacctttttcctgtttctcttgggtggtaataattttagggcatttgataagagtttgacttcagaaaaagaacaaagtgaagaaatgttcagctccatctcaggtgttcacatttgtgcataacttttattgaaaggctgacagggtaggctagcggaacggaggggtgtgtggaggagagtagcagggggtgggagggtcaagttgaaacagtgggtgcctgcgaagggtctccctattagccaggaagggaacagcacagaggggttcaagcgtgacagacggtgctgggaagtgggcagccgtagcagcctcccctgctgagcccggcgggcccagatgcgtatcaggcttgggtgggtcctgccaccttgctcacttggtaccggatttcccggggctgtgcccacagggaagtgttgctgctctggcaacatttcataaaggtgttgctcaacagcttcaggtatccctaggctgaagctgccaccaaacaggcacccggcctcctcctcctcaggctgccctgggaggagagctgtgggaccgcctcgccggctgagagccattacctgccgaccgtcggcaagtcagcctcacacccactggactctgctcccaagagcccaggctgttttcctcaaagctagcctcttttccagtcatcgatggattagtcctgatggctgaagtgctgagcagtgtcttcgttggaccagttttttattgtcatttgaggtggagatcagagatcatgaccagaagagtgtgagtgctgtcccttgccaccaacttcctagagatttcgggcagcactctacagcttcaatttcc

SEQ ID NO: 170135 - DNA, 778 bp, Homo sapiens
  Payload ID: 13509
  Gene Symbol: PSMG4
  Gene Name: proteasome (prosome, macropain) assembly chaperone 4
  ENST ID: ENST00000324987
  CDS Start-End: 47-373
gcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctaggaaggactgtcctcactcagtgtgataccgttcagggctcggagggaagactggcctggcctgtgagtgtggcgtagagtggggattaagcaaaggtcatgaggctgaatgctccactcttcccacaccccaacacacttcctgtgggccagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctc

SEQ ID NO: 170136 - DNA, 2110 bp, Homo sapiens
  Payload ID: 13510
  Gene Symbol: PSMB11
  Gene Name: proteasome (prosome, macropain) subunit, beta type, 11
  Uniprot ID: A5LHX3
  ENST ID: ENST00000408907
  CDS Start-End: 60-962
accagaccccagccacaaattcctggcttgcttcttccaaacttcattcagccccagggatggctctgcaggatgtgtgcaagtggcagtcccctgacacccagggaccatcacctcacctgcctcgggctggcggctgggctgtgccccggggttgtgaccctcaaaccttcctgcagatccatggccccagactggcccacggcaccaccactctggccttccgcttccgtcatggagtcattgctgcagctgacacgcgttcctcctgtggcagctatgtggcgtgtccagcctcatgcaaggtcatccctgtgcaccagcacctcctgggtaccacctctggcacctctgccgactgtgctacctggtatcgggtattacagcgggagctgcggcttcgggaactgagggagggtcagctgcccagtgtggccagtgctgccaagctcttgtcagccatgatgtctcaataccggggactggatctctgtgtggccactgccctctgcggctgggaccgctctggccctgagctcttctacgtctatagcgacggcacccgcctgcagggggacatcttctctgtgggctctggatctccctatgcctacggcgtgctagaccgtggctatcgctacgacatgagcacccaggaagcctacgccctggctcgctgcgccgtggcccacgccacccaccgtgatgcctattcagggggctctgtagaccttttccacgtgcgggagagtggatgggagcatgtgtcacgcagtgatgcctgtgtgctgtacgtggagttacagaagctcctggagccggagccagaggaggatgccagccatgcccatcctgagcctgccactgcccacagagctgcagaagatagagagctctctgtggggccaggggaggtgacaccaggagactccaggatgccagcagggactgagacggtgtgagaagcaggacttggttggggatggtgtaggcctggggagtgggtgggaggatgggcagcagggggagggtcccgctggcagcagcctcacagcgtctggctctagcctgtatgggttgctggcttcatttattgcaagtctccatcctttcatgactcccagagctattatggctctgcccaacaagttcctattgactcccagtggattggtccagcctccttcttggcaccaagtccgtctttcattcaacacttgcagtgtgcctactgcatgccagacgcatgctaggtgctagaccctcttttcttgccatcttctctgcttttttccatcatctcatccccagtttctcttagtttcggtcctttatgtgtctcagcttcagcgtctttgtctttttctcctgatcactttgtcagcatggtaagatggggcacccgggaagggagcagcccctctcagaacgaggcgtagtgatagacaccctttggatggtgatgggcttgtcttatctgctctccttctctgacttgaccatcatgactagaatgattatccctttactgaatgcagttctcatcgcaaccctttgaggtaaaaatgagtctctctttacagaagaggaatcaggttcaaagggttatgtggcttgccagggtcacacagtaagtggcagggatgacacttagatccaggccttctcctccagggtccatgctctttcagcacagctccccctcccaggccctctgccctgcctttcctctcttccctgcaggcttccggagagggatgtggagggagaaagtagctaggccagtcccctgcctggtggctcatgtggctttatcttccaggcctggagccatcccccacagcccacccttgctctccagctttctgggcctggcggtgccgctgccagacttcccctcctcctttcttccctttgccttctttccagcccctccttcctgatgctccctctggagaatgaagacaagagagaggtggctgtgccagtgggaactgtctggctagcacatcctctcctgcccctcctgtccctgctcccactcccctagaagcccagacttgaagatccagactaacacctccaggagggccactgccctgctgtcccc

SEQ ID NO: 170137 - DNA, 4448 bp, Homo sapiens
  Payload ID: 13511
  Gene Symbol: PSMC1
  Gene Name: proteasome 26S subunit, ATPase 1
  Uniprot ID: P62191
  ENST ID: ENST00000261303
  CDS Start-End: 104-1426
tggttcctatcagcttccgtagcgtccctaacgacttccgcctctggcgggccgcagtggtggaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacacttcctgtttctgcagtctccacacacacctaccgctcaacagcagcctgtgggtggacccagctacagggaagcctttggacaggaactcaggctgcggtcccaaggagtgtggacctcactatgcgttcgccacatcacacccccagagctggcgttcaacggtaattacagtgggaaatggtcactaccacagagccagggatattcgttgtttaaataataaaggctgcgttaatgtggctattgcttccaaaggaagtacagctttcctttttggaagttttgtggaccatgcatgttcttagcactctgagggcagaaaataactactggtgttcccaagagactgaggattcctagagatatcttgaaagcccttctgagcccttgggctcagaaatctcatccctttcaaggtgttcagaaacatgtcagaacttccccttccctttctccgtctatttccgtcatttctctttctgaacaaatcaggcctaaagctattaagtgggacagatcaaggtaagcgttcccttgacaggtggcctggtgtgggttgtagggcccacactgaatgaggagtgtgtattagttttctgttaatactataacaagttaccacaggctttgtttaaaaacagcacaatttggccaggcacggtggctcacgcctgtaatcccagcactttgggaagctgaggcaggcggatcacaaggtcagaagtttgaggccagcctggccaacatggtgaaaccccatctttactaaaaatacaaaaattagctgtgcgtggtggcaggtgcctgtagtcccagctactcaggaggctgaggcaggacaatcgcttgaacccaggaggcggaggttgcagtgagccaagatcccgtcactgcactccagcctgggcgacagagcaagactccgtctcaaaaataaataaataaataaataaaaaccacaattttatctcagttctgtaggtcagaagtccaacacgagtgtctccaggctaaagtcttgctgttggcaggaccgttccctctggcgtctctaagggagaatccgtttccttgctgaggattattgttggcagaatttaatttcttggagttgtgggccagctgaggtcagcatttccttgctggctgccagctgaggcctttgccagtctgtgaaggccaccctccctcctgactcgtggcacttcattttccaccagcagcagcaggcccagtccctctctcccaccgacccttctttctgcctgccttttctattcttatggatccttgtgattgcattggacccatgcagatgatccaggataatttccctgttttaaagtttacaatcttcttaatttttatctgcaaagttccttttgccatgtaacattcacacgttccagggcttagggtgtggccatctttaggggcgccactctgcctaccacagaggacatccacacgtgggggtggcccagtgcagggtaaggacggggtgcttgtggggagggcgggtgtcagcccaagtagggtgtggagctgtccatgtggaggaacaccacagcacggggactcagcatgggcagggtgaggctggcatccgtgtggggtgtatgtgcagggctggggtggtccgatagggggagtcagtgtgggcagcctgatgtgcagtatgagagcccaagtgggtgaggaaggcatctgcagggacggggtggtggcaggggagggaggctgcttatgtatggaggcagtcaggcaggtaaacaggacagtgggagccaggtttctctgaggagttagacacagaaagaagaaaacaagaacgacctctgtccactgggagcacctgggaacagtgacaccccaactgcagtgagcacccctagacccagacctttgctgctaaaagtattattctccactaaaaggagtgagggctgattccggggctaggcagggaaaggacaggatgaacccaaagtctgttttgccagaaagcaagggagtgctcaaggaatgataaggacatgtcctaaggacaccgaagcctatgtgaaggggcttccactggccaaactcgggacaatctgagcatcctaacaaacagttactattaatggaatacagtatagccctttaaatagggaactacacacacacacacacacacacacacacacacacacacacacacacacacaccccaatacatatgaattgatctgaaagtttgctgaggaaggggtatttacagattttgagagtctgccacaaaacactgttcagttagaaagggaaagtcacactggagatgcccagcagacaccgtcttcaccaagtggtcaaatgcacatcatcagtaatgggcactttgaaagtacgtgccacccaagagtgtcagtgctgtcacactcctgccaaagatgcttagcctgaatccagtgctgaggaaacaccaggcaaacacaaactgaggaacattctacaaattcagaacacttcaaaagtatccacgtcttggaagtcaaaaagcttccaatcagaaggagaccaaagagatgacaaccaagtgcagctcctgctcctgaactggatccttttcctagaggacatgactgggcctgaggacctgctaggagtactgcgtccatgctgacttcctgttcagtgtctgtatcgtgggcgggtagcagactctcagcaactgactcacacggttcaggaaacaaaattctttgtaacgcacttgcatcttttcctaagtttgagattaaaaaaaacaaaaaacccca

SEQ ID NO: 170138 - DNA, 1389 bp, Homo sapiens
  Payload ID: 13511
  Gene Symbol: PSMC1
  Gene Name: proteasome 26S subunit, ATPase 1
  Uniprot ID: P62191
  ENST ID: ENST00000543772
  CDS Start-End: 143-1246
gctcaagtggccaaggcaagatgggtcaaagtcagagtggtggtcatggtcctggaggtggcaagaaggatgacaagtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtg

SEQ ID NO: 170139 - DNA, 390 bp, Homo sapiens
  Payload ID: 13511
  Gene Symbol: PSMC1
  Gene Name: proteasome 26S subunit, ATPase 1
  ENST ID: ENST00000553835
  CDS Start-End: 138-390
gacttccgcctctggcgggccgcagtggtggaggaacttccggcagcggcagctcaagtggccaagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttct

SEQ ID NO: 170140 - DNA, 2637 bp, Homo sapiens
  Payload ID: 13512
  Gene Symbol: PSMC2
  Gene Name: proteasome 26S subunit, ATPase 2
  Uniprot ID: P35998
  ENST ID: ENST00000292644
  CDS Start-End: 1-1302
atgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctagaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttag

SEQ ID NO: 170141 - DNA, 3054 bp, Homo sapiens
  Payload ID: 13512
  Gene Symbol: PSMC2
  Gene Name: proteasome 26S subunit, ATPase 2
  Uniprot ID: P35998
  ENST ID: ENST00000435765
  CDS Start-End: 412-1713
agttttcctgtaaaaaggattatattccacgtcccagtgcaatacatagaacataacctttaaaagcagttctttttatattatctttaagttcttactgctttatgtattaatctgaacctaatcagtgattttcccaggagcgctatacttttaagtaaaaaatgaaaatacctgtatgaaccagtatcgacgactagtatatacatttgcggagaattacgtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctagaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacatctctttaaaattacctcctgtgtaaccaccaccaaatcctatcttctaccacaattaccccttcccccaatgccaagaccaaagcacaataatgaatatttttattgaagttcgatattcataaataagttgcaaaataagagttggatatatttttaattcacaatagaaaaagttgacaacatagaaaatgctgctttgcactgaaatacttaaaattatgaaagttttcaagtaaagaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacaca

SEQ ID NO: 170142 - DNA, 656 bp, Homo sapiens
  Payload ID: 13512
  Gene Symbol: PSMC2
  Gene Name: proteasome 26S subunit, ATPase 2
  ENST ID: ENST00000425206
  CDS Start-End: 266-656
ctggggtgctggggggttccgtcccgaaatgctcagcccaatccatgagtcagcagcggcgagaggaggaagcaacggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcac

SEQ ID NO: 170143 - DNA, 682 bp, Homo sapiens
  Payload ID: 13512
  Gene Symbol: PSMC2
  Gene Name: proteasome 26S subunit, ATPase 2
  ENST ID: ENST00000457587
  CDS Start-End: 292-682
atgagaacctttctggggtgctggggggttccgtcccgaaatgctcagcccaatccatgagtcagcagcggcgagaggaggaagcaacgtttccttctcacaggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcac

SEQ ID NO: 170144 - DNA, 1544 bp, Homo sapiens
  Payload ID: 13513
  Gene Symbol: PSMC3
  Gene Name: proteasome 26S subunit, ATPase 3
  Uniprot ID: P17980
  ENST ID: ENST00000298852
  CDS Start-End: 159-1478
attcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgcc

SEQ ID NO: 170145 - DNA, 905 bp, Homo sapiens
  Payload ID: 13513
  Gene Symbol: PSMC3
  Gene Name: proteasome 26S subunit, ATPase 3
  ENST ID: ENST00000530651
  CDS Start-End: 1-905
gatgaggccgaggtgggcaccgggcgagctggcggtccgggaaccggggcccgcagggagacgccattgacaagagggaaggaggtggctgggggtcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcg

SEQ ID NO: 170146 - DNA, 604 bp, Homo sapiens
  Payload ID: 13513
  Gene Symbol: PSMC3
  Gene Name: proteasome 26S subunit, ATPase 3
  ENST ID: ENST00000527906
  CDS Start-End: 25-138
agtccagtgactcggcaggagaagatggcgaccgtgtgggatgaggccgagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaa

SEQ ID NO: 170147 - DNA, 777 bp, Homo sapiens
  Payload ID: 13513
  Gene Symbol: PSMC3
  Gene Name: proteasome 26S subunit, ATPase 3
  ENST ID: ENST00000531051
  CDS Start-End: 5-777
gaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcg

SEQ ID NO: 170148 - DNA, 1390 bp, Homo sapiens
  Payload ID: 13513
  Gene Symbol: PSMC3
  Gene Name: proteasome 26S subunit, ATPase 3
  ENST ID: ENST00000530912
  CDS Start-End: 164-1357
ggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaa

SEQ ID NO: 170149 - DNA, 935 bp, Homo sapiens
  Payload ID: 13513
  Gene Symbol: PSMC3
  Gene Name: proteasome 26S subunit, ATPase 3
  ENST ID: ENST00000524447
  CDS Start-End: 1-935
accgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaa

SEQ ID NO: 170150 - DNA, 580 bp, Homo sapiens
  Payload ID: 13513
  Gene Symbol: PSMC3
  Gene Name: proteasome 26S subunit, ATPase 3
  ENST ID: ENST00000526993
  CDS Start-End: 28-580
gagagtccagtgactcggcaggagaagatggcgaccgtgtgggatgaggccgaggtgggcaccgggcgagctggcggtccgggaaccggggcccgcagggagacgccattgacaagagggaaggagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggagg

SEQ ID NO: 170151 - DNA, 891 bp, Homo sapiens
  Payload ID: 13513
  Gene Symbol: PSMC3
  Gene Name: proteasome 26S subunit, ATPase 3
  ENST ID: ENST00000530887
  CDS Start-End: 1-159
accgggcgagctggcggtccgggaaccggggcccgcagggagacgccattgacaagagggaaggaggtggctgggggtcaagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcg

SEQ ID NO: 170152 - DNA, 1373 bp, Homo sapiens
  Payload ID: 13513
  Gene Symbol: PSMC3
  Gene Name: proteasome 26S subunit, ATPase 3
  ENST ID: ENST00000602866
  CDS Start-End: 36-1307
cgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgcc

SEQ ID NO: 170153 - DNA, 1580 bp, Homo sapiens
  Payload ID: 13513
  Gene Symbol: PSMC3
  Gene Name: proteasome 26S subunit, ATPase 3
  Uniprot ID: P17980
  ENST ID: ENST00000619920
  CDS Start-End: 195-1514
gtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtccctgcc

SEQ ID NO: 170154 - DNA, 1591 bp, Homo sapiens
  Payload ID: 13514
  Gene Symbol: PSMC4
  Gene Name: proteasome 26S subunit, ATPase 4
  Uniprot ID: P43686
  ENST ID: ENST00000157812
  CDS Start-End: 199-1455
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 170155 - DNA, 1333 bp, Homo sapiens
  Payload ID: 13514
  Gene Symbol: PSMC4
  Gene Name: proteasome 26S subunit, ATPase 4
  Uniprot ID: P43686
  ENST ID: ENST00000455878
  CDS Start-End: 34-1197
atcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 170156 - DNA, 1333 bp, Homo sapiens; identical to SEQ ID NO: 170155
  Payload ID: 13514
  Gene Symbol: PSMC4
  Gene Name: Proteasome 26S subunit, ATPase 4
  ENST ID: ENST00000630857
  CDS Start-End: 34-1197

SEQ ID NO: 170157 - DNA, 1591 bp, Homo sapiens; identical to SEQ ID NO: 170154
  Payload ID: 13514
  Gene Symbol: PSMC4
  Gene Name: Proteasome 26S subunit, ATPase 4
  ENST ID: ENST00000629691
  CDS Start-End: 199-1455

SEQ ID NO: 170158 - DNA, 1579 bp, Homo sapiens
  Payload ID: 13515
  Gene Symbol: PSMC5
  Gene Name: proteasome 26S subunit, ATPase 5
  Uniprot ID: P62195
  ENST ID: ENST00000310144
  CDS Start-End: 309-1529
ctcaatactctgtccttgggttttgtaagttgaaagttgagactaggaaggcatatcacaagaactataaacagagtttcaatgaggcaacactgaggaggagttctactccttcctcatccccttccaaagcccctgaactcgagtagccgcccctcccatcatggttcccttagtgtggtctcgccgcacaccccgcccattgacccggaattcttctctgcctggtcttcaggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtc

SEQ ID NO: 170159 - DNA, 1494 bp, Homo sapiens
  Payload ID: 13515
  Gene Symbol: PSMC5
  Gene Name: proteasome 26S subunit, ATPase 5
  Uniprot ID: P62195
  ENST ID: ENST00000375812
  CDS Start-End: 241-1437
ggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctagg

SEQ ID NO: 170160 - DNA, 804 bp, Homo sapiens
  Payload ID: 13515
  Gene Symbol: PSMC5
  Gene Name: proteasome 26S subunit, ATPase 5
  ENST ID: ENST00000584320
  CDS Start-End: 80-804
ggctcggatgccggcggtctctgctgaagagagaagatggcgcttgacggaccagagcagactcactctgtgtcttcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacga

SEQ ID NO: 170161 - DNA, 1552 bp, Homo sapiens
  Payload ID: 13515
  Gene Symbol: PSMC5
  Gene Name: proteasome 26S subunit, ATPase 5
  Uniprot ID: P62195
  ENST ID: ENST00000580864
  CDS Start-End: 306-1502
ggatgccggcggtctctgctgaagagagaagatggcgcttgacggaccagagcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtc

SEQ ID NO: 170162 - DNA, 1178 bp, Homo sapiens
  Payload ID: 13515
  Gene Symbol: PSMC5
  Gene Name: proteasome 26S subunit, ATPase 5
  ENST ID: ENST00000585242
  CDS Start-End: 13-171
tgaagagagaagatggcgcttgacggaccagagcagatggagctggaggaggggaaggcaggcagcggactccgccaatattatctgtccaagattgaagaactccagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgt

SEQ ID NO: 170163 - DNA, 809 bp, Homo sapiens
  Payload ID: 13515
  Gene Symbol: PSMC5
  Gene Name: proteasome 26S subunit, ATPase 5
  ENST ID: ENST00000581842
  CDS Start-End: 165-809
cgccaagacggctcggatgccggcggtctctgctgaagagagaagatggcgcttgacggaccagagcagtactgacacctcgggcttgtagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattc

SEQ ID NO: 170164 - DNA, 828 bp, Homo sapiens
  Payload ID: 13515
  Gene Symbol: PSMC5
  Gene Name: proteasome 26S subunit, ATPase 5
  ENST ID: ENST00000582130
  CDS Start-End: 39-828
acggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggct

SEQ ID NO: 170165 - DNA, 1474 bp, Homo sapiens
  Payload ID: 13515
  Gene Symbol: PSMC5
  Gene Name: proteasome 26S subunit, ATPase 5
  Uniprot ID: P62195
  ENST ID: ENST00000581882
  CDS Start-End: 261-1457
ccgtctatatcatatcgcctctcggtcctcctaaaagtcgtatgaggtaggcggcgttcccattcttttattttagtcctgggaaaatggagggttccaagggagggagggattagaacccagatcctgagcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgt

SEQ ID NO: 170166 - DNA, 597 bp, Homo sapiens
  Payload ID: 13515
  Gene Symbol: PSMC5
  Gene Name: proteasome 26S subunit, ATPase 5
  ENST ID: ENST00000584880
  CDS Start-End: 1-383
caacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaagctcggcctccacacaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacc

SEQ ID NO: 170167 - DNA, 558 bp, Homo sapiens
  Payload ID: 13515
  Gene Symbol: PSMC5
  Gene Name: proteasome 26S subunit, ATPase 5
  ENST ID: ENST00000579708
  CDS Start-End: 129-558
tccgccattttgagtgtggccctagattgttctcaatactctgtccttgggttttgtcccaatcctccgcttccgcgcttgcgcgccaagacggctcggatgccggcggtctctgctgaagagagaagatggcgcttgacggaccagagcaggtatggcgggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtac

SEQ ID NO: 170168 - DNA, 899 bp, Homo sapiens
  Payload ID: 13515
  Gene Symbol: PSMC5
  Gene Name: proteasome 26S subunit, ATPase 5
  ENST ID: ENST00000585123
  CDS Start-End: 129-899
ggatgccggcggtctctgctgaagagagaagatggcgcttgacggaccagagcagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggg

SEQ ID NO: 170169 - DNA, 804 bp, Homo sapiens
  Payload ID: 13515
  Gene Symbol: PSMC5
  Gene Name: proteasome 26S subunit, ATPase 5
  ENST ID: ENST00000584536
  CDS Start-End: 20-529
tctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggag

SEQ ID NO: 170170 - DNA, 2188 bp, Homo sapiens
  Payload ID: 13516
  Gene Symbol: PSMC6
  Gene Name: proteasome 26S subunit, ATPase 6
  ENST ID: ENST00000445930
  CDS Start-End: 7-1218
acggccatggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggtaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacatatatattcttgtcttttctgagtatatttactgtggtcctttaggttctttagcaagtaaactatttgataacccagatggattgtggatttttgaatattattttaaaatagtacacatacttaatgttcataagatcatcttcttaaataaaacatggatgtgtgggtatgtctgtactcctcctttcagaaagtgtttacatattcttcatctactgtgattaagctcattgttggttaattgaaaatatacatgcacatccataactttttaaagagtatgattcaacgtaatatttgctaatatgtgactgggttttcttggtttatgtaagacgataggtccctgttgaggatgtggaggtctggaccctcttccaggaaaaattctaacatacaattttgcgtatactataatttcaggaaatttattgtttcccaagctcatccaaggactctttaggtatgtatggatacctggctaagagtgtatgatgtaggggatgtaggagtgtcagaaatgttcaaaacatgatttctgttacctatacatgattcttatatcatctggcaataaaagctataacaaa

SEQ ID NO: 170171 - DNA, 785 bp, Homo sapiens
  Payload ID: 13516
  Gene Symbol: PSMC6
  Gene Name: proteasome 26S subunit, ATPase 6
  ENST ID: ENST00000556813
  CDS Start-End: 1-785
ggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattgattatgaagcaattgtgaagctttcggatggctttaatggagcagatctgagaaatgtttgtactgaagcag

SEQ ID NO: 170172 - DNA, 563 bp, Homo sapiens
  Payload ID: 13516
  Gene Symbol: PSMC6
  Gene Name: proteasome 26S subunit, ATPase 6
  ENST ID: ENST00000553798
  CDS Start-End: 1-100
tagagataaggcgcttcaggactaccgcaagaagttgcttgaacacaaggagatcgacggccgtcttaaggagtgtgagtgcacctttctttccatttaatcaagtgcctcgactcgcttctgcctctgacaaagcagaagcctttcgccgagcccggcaaccgagccttagagatgaccaggcctagggccagggacaaggcgctttgtcatccggccctgagcttgtggagcagcactccttcgggtgtagaaatggcccagtccagcccgggtgacagaacatcggcggccttgagtaagggaacaattaaaagaacttaccaagcagtatgaaaagtctgaaaatgatctgaaggccctacagagtgttgggcagatcgtgggtgaagtgcttaaacagttaactgaagaaaaatgtgagtgatgaattagcttattaattagtaaagaaacagtccacctctctctcacttttgaaatgcttattattttaatgacaataatgcagagagagagagtatttttgaatagacttaagttttccttcaactaatgtctcc

SEQ ID NO: 170173 - DNA, 844 bp, Homo sapiens
  Payload ID: 13516
  Gene Symbol: PSMC6
  Gene Name: proteasome 26S subunit, ATPase 6
  ENST ID: ENST00000554044
  CDS Start-End: 12-224
ggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaatgtgagtgatgaattagcttattaattagtaaagaaacagtccacctctctctcacttttgaaatgcttattattttaatgacaataatgcagagagagagagtatttttgaatagacttaagttttccttcaactaatgtctccttggaggacagaaatacaactaaaccctctgtcaacgtggcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaa

SEQ ID NO: 170174 - DNA, 583 bp, Homo sapiens
  Payload ID: 13516
  Gene Symbol: PSMC6
  Gene Name: proteasome 26S subunit, ATPase 6
  ENST ID: ENST00000555339
  CDS Start-End: 2-583
catggcggaccctagagataaggcgcttcaggactaccgcaagaagttgcttgaacacaaggagatcgacggccgtcttaaggagttcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaa

SEQ ID NO: 170175 - DNA, 625 bp, Homo sapiens
  Payload ID: 13516
  Gene Symbol: PSMC6
  Gene Name: proteasome 26S subunit, ATPase 6
  ENST ID: ENST00000557240
  CDS Start-End: 29-322
catcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgc

SEQ ID NO: 170176 - DNA, 580 bp, Homo sapiens
  Payload ID: 13516
  Gene Symbol: PSMC6
  Gene Name: proteasome 26S subunit, ATPase 6
  ENST ID: ENST00000557517
  CDS Start-End: 1-44
acggccgtcttaaggagtgtgagtgcacctttctttccatttaatcaagtgcctcgactcgcttctgcctctgacaaagcagaagcctttcgccgagcccggcaaccgagccttagagatgaccaggcctagggccagggacaaggcgctttgtcatccggccctgagcttgtggagcagcactccttcgggtgtagaaatggcccagtccagcccgggtgacagaacatcggcggccttgagtaagggaacaattaaaagaacttaccaagcagtatgaaaagtctgaaaatgatctgaaggccctacagagtgttgggcagatcgtgggtgaagtgcttaaacagttaactgaagaaaaatgtgagtgatgaattagcttattaattagtaaagaaacagtccacctctctctcacttttgaaatgcttattattttaatgacaataatgcagagagagagagtatttttgaatagacttaagttttccttcaactaatgtctccttggaggacagaaatacaactaaaccctctgtcaacgtggggctctgtggatgccgaaagttggcatttctaa

SEQ ID NO: 170177 - DNA, 752 bp, Homo sapiens
  Payload ID: 13516
  Gene Symbol: PSMC6
  Gene Name: proteasome 26S subunit, ATPase 6
  ENST ID: ENST00000555175
  CDS Start-End: 1-202
tgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggtaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctaca

SEQ ID NO: 170178 - DNA, 706 bp, Homo sapiens
  Payload ID: 13516
  Gene Symbol: PSMC6
  Gene Name: proteasome 26S subunit, ATPase 6
  ENST ID: ENST00000553899
  CDS Start-End: 19-129
gagagacggcttctcatcatggcggaccctagagataaggcgcttcaggactaccgcaagaagttgcttgaacacaaggagatcgacggccgtcttaaggagtgtgagtgcacctttctttccatttaatcaagtgcctcgactcgcttctgcctctgacaaagcagaagcctttcgccgagcccggcaaccgagccttagagatgaccaggcctagggccagggacaaggcgctttgtcatccggccctgagcttgtggagcagcactccttcgggtgtagaaatggcccagtccagcccgggtgacagaacatcggcggccttgagtaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaa

SEQ ID NO: 170179 - DNA, 1560 bp, Homo sapiens
  Payload ID: 13516
  Gene Symbol: PSMC6
  Gene Name: proteasome 26S subunit, ATPase 6
  Uniprot ID: P62333
  ENST ID: ENST00000606149
  CDS Start-End: 17-1186
gagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggtaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcct

SEQ ID NO: 170180 - DNA, 1590 bp, Homo sapiens
  Payload ID: 13516
  Gene Symbol: PSMC6
  Gene Name: proteasome 26S subunit, ATPase 6
  ENST ID: ENST00000612399
  CDS Start-End: 1-1212
atggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggtaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacat

SEQ ID NO: 170181 - DNA, 3326 bp, Homo sapiens
  Payload ID: 13517
  Gene Symbol: PSMD1
  Gene Name: proteasome 26S subunit, non-ATPase 1
  Uniprot ID: Q99460
  ENST ID: ENST00000308696
  CDS Start-End: 163-3024
ggggtcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaa

SEQ ID NO: 170182 - DNA, 3230 bp, Homo sapiens
  Payload ID: 13517
  Gene Symbol: PSMD1
  Gene Name: proteasome 26S subunit, non-ATPase 1
  Uniprot ID: Q99460
  ENST ID: ENST00000373635
  CDS Start-End: 163-2931
ggggtcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcct

SEQ ID NO: 170183 - DNA, 2901 bp, Homo sapiens
  Payload ID: 13517
  Gene Symbol: PSMD1
  Gene Name: proteasome 26S subunit, non-ATPase 1
  Uniprot ID: Q99460
  ENST ID: ENST00000409643
  CDS Start-End: 133-2901
tgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaa

SEQ ID NO: 170184 - DNA, 491 bp, Homo sapiens
  Payload ID: 13517
  Gene Symbol: PSMD1
  Gene Name: proteasome 26S subunit, non-ATPase 1
  ENST ID: ENST00000444007
  CDS Start-End: 1-491
agcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagaatcttcgaactgttggcacccctattgcttctgtgcctggatccactaatacgggtactgttccgggatcagagaaagacagtgactcgatggaaacagaagaaaagacaagcagtgcatttgtaggaaagacaccag

SEQ ID NO: 170185 - DNA, 2506 bp, Homo sapiens
  Payload ID: 13517
  Gene Symbol: PSMD1
  Gene Name: proteasome 26S subunit, non-ATPase 1
  ENST ID: ENST00000431051
  CDS Start-End: 160-306
gtcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggct

SEQ ID NO: 170186 - DNA, 761 bp, Homo sapiens
  Payload ID: 13517
  Gene Symbol: PSMD1
  Gene Name: proteasome 26S subunit, non-ATPase 1
  ENST ID: ENST00000440838
  CDS Start-End: 152-761
gagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattataggtaattatcgtctatctgcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtac

SEQ ID NO: 170187 - DNA, 696 bp, Homo sapiens
  Payload ID: 13517
  Gene Symbol: PSMD1
  Gene Name: proteasome 26S subunit, non-ATPase 1
  ENST ID: ENST00000447633
  CDS Start-End: 1-578
caggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggtaaagcccacagccaatggggtcagttctttcttggcgccagactgttttccctcgccgcagaatttatgtaacagctgtaaaaatacaagtgcaatgtgatctgtaagagtaaacttgccatacaaagcttcccagtactccctcattctgcgatgctggattgcccaaagctgcttaagaataaatcgtcacattacatggatagctgtaactgaaa

SEQ ID NO: 170188 - DNA, 3161 bp, Homo sapiens
  Payload ID: 13517
  Gene Symbol: PSMD1
  Gene Name: proteasome 26S subunit, non-ATPase 1
  ENST ID: ENST00000619128
  CDS Start-End: 1-2862
atggctacatctaaagctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcct

SEQ ID NO: 170189 - DNA, 1546 bp, Homo sapiens
  Payload ID: 13518
  Gene Symbol: PSMD10
  Gene Name: proteasome 26S subunit, non-ATPase 10
  Uniprot ID: O75832
  ENST ID: ENST00000217958
  CDS Start-End: 99-779
attggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 170190 - DNA, 713 bp, Homo sapiens
  Payload ID: 13518
  Gene Symbol: PSMD10
  Gene Name: proteasome 26S subunit, non-ATPase 10
  ENST ID: ENST00000340200
  CDS Start-End: 1-582
atggaggggtgtgtgtctaacctaatggtctgcaacctggcctacagcgggaagctggaagagttgaaggagagtattctggccgataaatccctggctactagaactgaccaggcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgt

SEQ ID NO: 170191 - DNA, 768 bp, Homo sapiens
  Payload ID: 13518
  Gene Symbol: PSMD10
  Gene Name: proteasome 26S subunit, non-ATPase 10
  Uniprot ID: O75832
  ENST ID: ENST00000361815
  CDS Start-End: 23-478
aagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaaggacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcc

SEQ ID NO: 170192 - DNA, 779 bp, Homo sapiens
  Payload ID: 13518
  Gene Symbol: PSMD10
  Gene Name: proteasome 26S subunit, non-ATPase 10
  ENST ID: ENST00000372295
  CDS Start-End: 23-580
aagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgt

SEQ ID NO: 170193 - DNA, 878 bp, Homo sapiens
  Payload ID: 13518
  Gene Symbol: PSMD10
  Gene Name: proteasome 26S subunit, non-ATPase 10
  ENST ID: ENST00000372296
  CDS Start-End: 23-355
aagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcagcttcgaaaaacaggcatgagatcgctgtcatgttactggaaggcggggctaatccagatgctaaggaccattatgaggctacagcaatgcaccgggcagcagccaaggacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtgg

SEQ ID NO: 170194 - DNA, 4098 bp, Homo sapiens
  Payload ID: 13519
  Gene Symbol: PSMD11
  Gene Name: proteasome 26S subunit, non-ATPase 11
  Uniprot ID: O00231
  ENST ID: ENST00000261712
  CDS Start-End: 264-1532
gatctagagctcccactgcggggcaccgcctcttttcctcgccggccgcccgctaggaggcgctggggagcttgcagcccacctgcgaggcggtcccgctctccccacccctcagcccgcgcccggcggagagactacaactcccggagtgctctgggaacggagccacgggagctacaggcggagggacccgagggcgggctttccgggtgtgtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataatttttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatgagttcaggtgtcttcttccagggcagcatggtccagtgagcacatgtaagtttgggcagtagatcctctgagcctactttctcttctactcagtgaggatgctgcttccttggcaggtgattgtgatgtgaagcttagtaagtcatagacgtgcaggtgtctggagagtcctgacatgcagttgtggtttcgtttccttttggaatcttcaaaggcagcgattttcatattgcctcacaccctggcgggggcggggggctctgggaccactgggggacctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattc

SEQ ID NO: 170195 - DNA, 2159 bp, Homo sapiens
  Payload ID: 13519
  Gene Symbol: PSMD11
  Gene Name: proteasome 26S subunit, non-ATPase 11
  Uniprot ID: O00231
  ENST ID: ENST00000457654
  CDS Start-End: 51-1319
gtgtttccggcgtcggcggccgcggccggggacggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggc

SEQ ID NO: 170196 - DNA, 480 bp, Homo sapiens
  Payload ID: 13519
  Gene Symbol: PSMD11
  Gene Name: proteasome 26S subunit, non-ATPase 11
  ENST ID: ENST00000578213
  CDS Start-End: 344-480
gcgcccggcggagagactacaactcccggagtgctctgggaacggagccacgggagctacaggcggagggacccgagggcgggctttccgggtgtgtgtttccggcgtcggcggccgcggccggggacggtgtgagagcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtacca

SEQ ID NO: 170197 - DNA, 540 bp, Homo sapiens
  Payload ID: 13519
  Gene Symbol: PSMD11
  Gene Name: proteasome 26S subunit, non-ATPase 11
  ENST ID: ENST00000580904
  CDS Start-End: 525-540
gaattggctcaacaagtagtatgagaatgcacctgtatgtgggacttgcaagatgttggcatttgacttagtgtgttgaattttggtattccagacctgcacggagaaaggacaatgacaagatcttgatactttatcattggggatactagagaaggagaggaagtgggcgtcaaggtgtatctttgaatgatattggtaaaaggtgtttcattttaaaagttctgatcttaggtcagttacttctacggaaccagagtcatctcaatcaccgttacatggatattttattctgagtacacactattatttagaactaattgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacag

SEQ ID NO: 170198 - DNA, 582 bp, Homo sapiens
  Payload ID: 13519
  Gene Symbol: PSMD11
  Gene Name: proteasome 26S subunit, non-ATPase 11
  ENST ID: ENST00000579451
  CDS Start-End: 20-582
acggtgtgagagcggtaagatggcggcggcggcggtggtggagttccagagagcccagtctctactcagcaccgaccgggaggcctccatcgacatcctccactccatcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggagtttctctttgttacagggcatttgatactttgggtctgttccatgctttgctttgtaagtggagattgtcagtggtccctggaatcctcattacatcagggtcacaaactgattcttgtctttgaggtcgagctgtgtttagagtgcatcgaatgggccaagtcagagaaaagaactttcttacgccaagctttggaggcaagactggtgtctttgtactttgataccaagaggtaccaggaagc

SEQ ID NO: 170199 - DNA, 559 bp, Homo sapiens
  Payload ID: 13519
  Gene Symbol: PSMD11
  Gene Name: proteasome 26S subunit, non-ATPase 11
  ENST ID: ENST00000584340
  CDS Start-End: 1-271
caaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacacgtaggtgcaccttaactctggactacaagaactcagatccttcagcaagtctgtttgccatggcagagatggcctgagcagggagtttggccagttacagaaacagcagcagctgcggcctctagggctggctaagcccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccggga

SEQ ID NO: 170200 - DNA, 4406 bp, Homo sapiens
  Payload ID: 13520
  Gene Symbol: PSMD12
  Gene Name: proteasome 26S subunit, non-ATPase 12
  Uniprot ID: O00232
  ENST ID: ENST00000356126
  CDS Start-End: 109-1479
gcgtgggctcccgatgggctgcctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagctatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactactttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggccgggtgcagtggatcccagcactttgggaggccaaggcgggtggatcatctaaggtcaggatttcgagactagcctggccaacatggcaaaaccctgtctctactaaaaaaaatacaaaaatttgccgggcgtggtggcgtgtgcctgtagtcccagttacttgggaggctgaggtgggagaattccttgaagccaggaggcggaggttgcagtgagccaagatcacaccattgcactccagcctgggtgacagagtgagactccgtctcaaaaaaaaaaaaacaaaactggaaagttcagaaacagaagttcacactaacagagtatggttttaattttcctttgaatgaaaaggatagaagataaaattgtgtattgttaacatgtaaataaaattggagctaatttgaaactagcttctcaataacttcatctttctagagactcattacctgtgggcttgtcaaacctggactatttggccaaataggttgctatagagattgcaagtgttcctcctctttatttttttcatattttttgagacggagtttcactcttgttgcccaggctggattgcagtgtcacgatctcggctcactgcaacctttgcctcccatattcaagcagttctcctgcctcaacctcccaagtagctgggattataggcgcctgccaccacacctagctaatttttgtgtttttagtagagatggtttcatcatgttggccgggctggtctcaaactcctgacctcaggtgatccacccgccttggctgcccaaagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatca

SEQ ID NO: 170201 - DNA, 2437 bp, Homo sapiens
  Payload ID: 13520
  Gene Symbol: PSMD12
  Gene Name: proteasome 26S subunit, non-ATPase 12
  Uniprot ID: O00232
  ENST ID: ENST00000357146
  CDS Start-End: 87-1397
ctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagctatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactactttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctg

SEQ ID NO: 170202 - DNA, 1752 bp, Homo sapiens
  Payload ID: 13520
  Gene Symbol: PSMD12
  Gene Name: proteasome 26S subunit, non-ATPase 12
  ENST ID: ENST00000584008
  CDS Start-End: 29-157
gacagcaagggacgctcaggcggggaccatggcggacggcggctcggagcgggctgacgggcgcatcgtcaagatggaggtggactacagcgccacggtggatcagcgcctacccgagtgtgcgaagctagccaaggcatgcctttataggtattgatttaaatcttacaccaaccctgtggattggtacaattattgtgcccacttcgctgaagagaaaattgagagtcagagagcttgtgttttactcaaggttgtgtaacaaatcattgaaagattggattcattcaggaattaaaggaggtgcaaacagaacttatactcaacattgatgttgaacaaactcattagtcgcttacatcatttacaaggattattttaatgaggaaaatgagtcactgaagtcacatgttctaacaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtata

SEQ ID NO: 170203 - DNA, 560 bp, Homo sapiens
  Payload ID: 13520
  Gene Symbol: PSMD12
  Gene Name: proteasome 26S subunit, non-ATPase 12
  ENST ID: ENST00000579365
  CDS Start-End: 59-175
gtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggttgtgtaacaaatcattgaaagattggattcattcaggaattaaaggaggtgcaaacagaacttatactcaacattgatgttgaacaaactcattagtcgcttacatcatttacaaggattattttaatgaggaaaatgagtcactgaagtcacatgttctaacaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgt

SEQ ID NO: 170204 - DNA, 1427 bp, Homo sapiens
  Payload ID: 13521
  Gene Symbol: PSMD13
  Gene Name: proteasome 26S subunit, non-ATPase 13
  ENST ID: ENST00000352303
  CDS Start-End: 25-1074
tgtgccgggggtcttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatg

SEQ ID NO: 170205 - DNA, 1489 bp, Homo sapiens
  Payload ID: 13521
  Gene Symbol: PSMD13
  Gene Name: proteasome 26S subunit, non-ATPase 13
  ENST ID: ENST00000382671
  CDS Start-End: 13-231
cttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgtt

SEQ ID NO: 170206 - DNA, 1591 bp, Homo sapiens
  Payload ID: 13521
  Gene Symbol: PSMD13
  Gene Name: proteasome 26S subunit, non-ATPase 13
  Uniprot ID: Q9UNM6
  ENST ID: ENST00000431206
  CDS Start-End: 74-1210
agcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaactttatgaaaactttatcagtgaatttgaacacaggtaaaagcctctcatccgtttttcactttgaaaatgagtgcattgatgctcggcggtgctcaaaggctggtggcttttatttcagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgtt

SEQ ID NO: 170207 - DNA, 892 bp, Homo sapiens
  Payload ID: 13521
  Gene Symbol: PSMD13
  Gene Name: proteasome 26S subunit, non-ATPase 13
  ENST ID: ENST00000526783
  CDS Start-End: 1-665
ctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagg

SEQ ID NO: 170208 - DNA, 858 bp, Homo sapiens
  Payload ID: 13521
  Gene Symbol: PSMD13
  Gene Name: proteasome 26S subunit, non-ATPase 13
  ENST ID: ENST00000528906
  CDS Start-End: 70-858
tttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaaggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaa

SEQ ID NO: 170209 - DNA, 1632 bp, Homo sapiens
  Payload ID: 13521
  Gene Symbol: PSMD13
  Gene Name: proteasome 26S subunit, non-ATPase 13
  ENST ID: ENST00000525665
  CDS Start-End: 51-263
cggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacaggtaaaagcctctcatccgtttttcactttgaaaatgagtgcattgatgctcggcggtgctcaaaggctggtggcttttatttcagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaa

SEQ ID NO: 170210 - DNA, 1991 bp, Homo sapiens
  Payload ID: 13521
  Gene Symbol: PSMD13
  Gene Name: proteasome 26S subunit, non-ATPase 13
  Uniprot ID: Q9UNM6
  ENST ID: ENST00000532097
  CDS Start-End: 505-1635
agtctggtgtctcatctctcgccccggaggtcaaacctggagccagcatttctgtaccctgcgctcacacctttttcaacccggatggcggtgatagttaatactttctgagcgcttttactatggtcaggcattatatttacacctaatcctcgcaaaacactactgggaagatcctcatttgacaggagcaattccgggtcacaaaggctgacaccacaaagctagtccgtagcgggttcgaccacaggcgcccacactctttgacgcctcaatggcacagccaagtgcgcgggaagtgggctgcaaacgccggagagttttgtccggagcgcagagacgcgctgtaaccgagcaaccagcggggcccgcccccggcctgctacggcgctcccagcctgccccgcgccgctcggcgccggaagtgagtgagcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttc

SEQ ID NO: 170211 - DNA, 612 bp, Homo sapiens
  Payload ID: 13521
  Gene Symbol: PSMD13
  Gene Name: proteasome 26S subunit, non-ATPase 13
  ENST ID: ENST00000529372
  CDS Start-End: 85-426
ggaagtgagtgagcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcagga

SEQ ID NO: 170212 - DNA, 1572 bp, Homo sapiens
  Payload ID: 13521
  Gene Symbol: PSMD13
  Gene Name: proteasome 26S subunit, non-ATPase 13
  ENST ID: ENST00000621534
  CDS Start-End: 55-1188
cccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagctttatgaaaactttatcagtgaatttgaacacagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacaggtgatgtgtatcaaggaaggaccgcctggagttctggtgcacggagtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttctt

SEQ ID NO: 170213 - DNA, 1954 bp, Homo sapiens
  Payload ID: 13522
  Gene Symbol: PSMD14
  Gene Name: proteasome 26S subunit, non-ATPase 14
  Uniprot ID: O00487
  ENST ID: ENST00000409682
  CDS Start-End: 705-1637
agataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagacagagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 170214 - DNA, 577 bp, Homo sapiens
  Payload ID: 13522
  Gene Symbol: PSMD14
  Gene Name: proteasome 26S subunit, non-ATPase 14
  ENST ID: ENST00000437630
  CDS Start-End: 325-577
ttcaggtaagacccagaaggcaggcctgggaggtctggggaggcagccgtgctaggccgccgccagccccgtgctttcctgagtcacgttgcccagctgagttgccacaggaggcctgggccgcgagggaggagcccggcctccttcattctcttcgcctgctctcagggctctctggcagggtcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtgg

SEQ ID NO: 170215 - DNA, 3449 bp, Homo sapiens
  Payload ID: 13523
  Gene Symbol: PSMD2
  Gene Name: proteasome 26S subunit, non-ATPase 2
  Uniprot ID: Q13200
  ENST ID: ENST00000310118
  CDS Start-End: 559-3285
caacaacaacaacaaaaccaaatgaggttaatattccacagtggtgtggggctagacacagttacacagactttatacaggcggcaatcaagcgtcctggacgtcaagaaatctagtttgtctgtcgcgccacgcagtcaactggagtgtcactgtgggttctatttacaccgttatgagaaaaacctgtggcggagtaaaactcggtaactccgctcgcagaccgcccatctacagcagtgagcgaacccaaaccccacacggccaagtcccgcgggtttcaggaaactccgaagaggtcgggggccaggggcgactatggcgcgggggaggctgggaattgtagtctccacctgcctccgagggcggggtccgagggcggggctctcaggccgagggggtgggtgggtcgccgagcgccccggctcgccccggcgtttccggtcgcaggcgggctctggaggaggaggggcgccgcgaccgacgcgcgcgagttggtctgggaaaaagggcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaggtc

SEQ ID NO: 170216 - DNA, 609 bp, Homo sapiens
  Payload ID: 13523
  Gene Symbol: PSMD2
  Gene Name: proteasome 26S subunit, non-ATPase 2
  ENST ID: ENST00000432855
  CDS Start-End: 1-609
agaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatt

SEQ ID NO: 170217 - DNA, 2574 bp, Homo sapiens
  Payload ID: 13523
  Gene Symbol: PSMD2
  Gene Name: proteasome 26S subunit, non-ATPase 2
  Uniprot ID: Q13200
  ENST ID: ENST00000435761
  CDS Start-End: 215-2464
aaaatatctacagaagagctgaaaggaaggtcagcttctcagaagacactgtttctgtcatgtgtattggactttggggtttcattagcatggtctacttttaaccgttttgctgctgacatcatctccgttttggccatgaccatgagtggggagcgtgagtgcctcaagtatcggctagtgggctcccaggaggaattggcatcatggggtcatgagtatgtcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctc

SEQ ID NO: 170218 - DNA, 825 bp, Homo sapiens
  Payload ID: 13523
  Gene Symbol: PSMD2
  Gene Name: proteasome 26S subunit, non-ATPase 2
  ENST ID: ENST00000445558
  CDS Start-End: 1-430
aggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcagagaagtgcttcccctgaagctgtgctctcttaatcgtctgggactatctgtaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatc

SEQ ID NO: 170219 - DNA, 942 bp, Homo sapiens
  Payload ID: 13523
  Gene Symbol: PSMD2
  Gene Name: proteasome 26S subunit, non-ATPase 2
  ENST ID: ENST00000433010
  CDS Start-End: 14-193
agtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctggtgaggcgcgaccccgagagtcggcgaaggaggctgcggggctgagtcacggcggctccgcaggcctcaggcccgacacccaactaccccaccgcgccagggagagggcggttggggcgaccctcgggactcccggcaccttgcctctctgctcctcattctccgttccgcgctgtcacctccgccgtccccaccaaccctcaccaccgccgcgtgaagtggactcgggcagtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatc

SEQ ID NO: 170220 - DNA, 721 bp, Homo sapiens
  Payload ID: 13523
  Gene Symbol: PSMD2
  Gene Name: proteasome 26S subunit, non-ATPase 2
  ENST ID: ENST00000417952
  CDS Start-End: 70-721
gcgagttggtctgggaaaaagggcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaac

SEQ ID NO: 170221 - DNA, 2633 bp, Homo sapiens
  Payload ID: 13523
  Gene Symbol: PSMD2
  Gene Name: proteasome 26S subunit, non-ATPase 2
  Uniprot ID: Q13200
  ENST ID: ENST00000439383
  CDS Start-End: 139-2475
aaaatatctacagaagagctgaaaggaaggtcagcttctcagaagacactgtttctgtcatgtgtattggactttggggtttcattagcatggtctacttttaaccgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatcccc

SEQ ID NO: 170222 - DNA, 2158 bp, Homo sapiens
  Payload ID: 13524
  Gene Symbol: PSMD3
  Gene Name: proteasome 26S subunit, non-ATPase 3
  Uniprot ID: O43242
  ENST ID: ENST00000264639
  CDS Start-End: 175-1779
ggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgc

SEQ ID NO: 170223 - DNA, 1598 bp, Homo sapiens
  Payload ID: 13524
  Gene Symbol: PSMD3
  Gene Name: proteasome 26S subunit, non-ATPase 3
  ENST ID: ENST00000415039
  CDS Start-End: 136-396
agctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaagggttggtaagattaaaagaagtccctgtattgaggcacttagcgaagtctaaattgtaaaaaagatggcgctggtatctagctccacaaaagggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaat

SEQ ID NO: 170224 - DNA, 458 bp, Homo sapiens
  Payload ID: 13524
  Gene Symbol: PSMD3
  Gene Name: proteasome 26S subunit, non-ATPase 3
  ENST ID: ENST00000540504
  CDS Start-End: 1-353
cccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccac

SEQ ID NO: 170225 - DNA, 1333 bp, Homo sapiens
  Payload ID: 13525
  Gene Symbol: PSMD4
  Gene Name: proteasome 26S subunit, non-ATPase 4
  ENST ID: ENST00000368881
  CDS Start-End: 75-1217
gagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaacttt

SEQ ID NO: 170226 - DNA, 1350 bp, Homo sapiens
  Payload ID: 13525
  Gene Symbol: PSMD4
  Gene Name: proteasome 26S subunit, non-ATPase 4
  Uniprot ID: P55036
  ENST ID: ENST00000368884
  CDS Start-End: 81-1214
ggtgaagagcgacgggccaattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 170227 - DNA, 703 bp, Homo sapiens
  Payload ID: 13525
  Gene Symbol: PSMD4
  Gene Name: proteasome 26S subunit, non-ATPase 4
  ENST ID: ENST00000445776
  CDS Start-End: 1-580
gggaagcccagtggaggacaatgagaaggatctggtgaaactggctaaacgcctcaagaaggagaaagtaaatgttgacattatcaattttggggaagaggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttcct

SEQ ID NO: 170228 - DNA, 371 bp, Homo sapiens
  Payload ID: 13525
  Gene Symbol: PSMD4
  Gene Name: proteasome 26S subunit, non-ATPase 4
  ENST ID: ENST00000453615
  CDS Start-End: 1-254
acattgatgccagctcagctatggacacatctgagccagccaagagctcaattaacagagttctcagcaggcccctctatttggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 170229 - DNA, 649 bp, Homo sapiens
  Payload ID: 13525
  Gene Symbol: PSMD4
  Gene Name: proteasome 26S subunit, non-ATPase 4
  ENST ID: ENST00000427779
  CDS Start-End: 1-119
ggcaggaggaggaggcccggcgggcagctgcagcttctgctgctgaggccgggattgctacgactgggactgaaggtgaaagaggtggaatccgaagtcctgggactgcgggatgctaaacattgaaagctgggtgtaggcactgcagggagagtgtggagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 170230 - DNA, 787 bp, Homo sapiens
  Payload ID: 13525
  Gene Symbol: PSMD4
  Gene Name: proteasome 26S subunit, non-ATPase 4
  ENST ID: ENST00000437736
  CDS Start-End: 179-787
aattagctggcatggtggtgcacgcctgtggtcccagctacccgggaagctgaagtgggaagatctattgagcctgggaggttgaggctacagtgagctgtgactgcgcttgaacctgtgcctgcgcttgaacctgtgcctgaatactaccctagacagtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttg

SEQ ID NO: 170231 - DNA, 3443 bp, Homo sapiens
  Payload ID: 13526
  Gene Symbol: PSMD5
  Gene Name: proteasome 26S subunit, non-ATPase 5
  Uniprot ID: Q16401
  ENST ID: ENST00000210313
  CDS Start-End: 76-1590
gatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagtaaa

SEQ ID NO: 170232 - DNA, 1538 bp, Homo sapiens
  Payload ID: 13526
  Gene Symbol: PSMD5
  Gene Name: proteasome 26S subunit, non-ATPase 5
  Uniprot ID: Q16401
  ENST ID: ENST00000373904
  CDS Start-End: 43-1428
gggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcgctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcat

SEQ ID NO: 170233 - DNA, 569 bp, Homo sapiens
  Payload ID: 13526
  Gene Symbol: PSMD5
  Gene Name: proteasome 26S subunit, non-ATPase 5
  ENST ID: ENST00000373920
  CDS Start-End: 1-342
ggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacgggaaggaaacacctgcatcttgaagaactagtaggaggcaatcaagtgaagaatacagtggagtagcaaagcaagacagcaggtacacatgaaaacaagagaacatgtttgagaaactacaagtaattcaatatgaccaacgcctaggatttaaagggaaatttttgcaaaattctttatcattattactaataatagctaccatttcttagcattgattttatgttaggcacttggcatgcatttcttactttatcatcataatagccataaaagttacgtatcatttcaca

SEQ ID NO: 170234 - DNA, 382 bp, Homo sapiens
  Payload ID: 13526
  Gene Symbol: PSMD5
  Gene Name: proteasome 26S subunit, non-ATPase 5
  ENST ID: ENST00000476949
  CDS Start-End: 3-221
agatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatg

SEQ ID NO: 170235 - DNA, 219 bp, Homo sapiens
  Payload ID: 13526
  Gene Symbol: PSMD5
  Gene Name: proteasome 26S subunit, non-ATPase 5
  ENST ID: ENST00000625444
  CDS Start-End: 1-219
atggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagattggaagaattgttgaaaattctgatgctgttactgagattctaa

SEQ ID NO: 170236 - DNA, 1430 bp, Homo sapiens
  Payload ID: 13527
  Gene Symbol: PSMD6
  Gene Name: proteasome 26S subunit, non-ATPase 6
  Uniprot ID: Q15008
  ENST ID: ENST00000295901
  CDS Start-End: 142-1311
agcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttcca

SEQ ID NO: 170237 - DNA, 1349 bp, Homo sapiens
  Payload ID: 13527
  Gene Symbol: PSMD6
  Gene Name: proteasome 26S subunit, non-ATPase 6
  Uniprot ID: Q15008
  ENST ID: ENST00000394431
  CDS Start-End: 176-1231
cgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatgacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttcc

SEQ ID NO: 170238 - DNA, 469 bp, Homo sapiens
  Payload ID: 13527
  Gene Symbol: PSMD6
  Gene Name: proteasome 26S subunit, non-ATPase 6
  ENST ID: ENST00000478185
  CDS Start-End: 38-469
aagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacttttggaacagaatccggcaagagcaaaccgaggattgccctccctccagccctagtagagacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcc

SEQ ID NO: 170239 - DNA, 1495 bp, Homo sapiens
  Payload ID: 13527
  Gene Symbol: PSMD6
  Gene Name: proteasome 26S subunit, non-ATPase 6
  Uniprot ID: Q15008
  ENST ID: ENST00000492933
  CDS Start-End: 54-1382
gcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacttttggaacagaatccggcaagagcaaaccgaggattgccctccctccagccctagtagaggttggcattgccaggattggccgtcacgcaaacctcccaccagcatacgtttatgttttgccaagccgattattaagcgccatcgcatgccttcctacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttc

SEQ ID NO: 170240 - DNA, 657 bp, Homo sapiens
  Payload ID: 13527
  Gene Symbol: PSMD6
  Gene Name: proteasome 26S subunit, non-ATPase 6
  ENST ID: ENST00000480205
  CDS Start-End: 1-415
taatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttct

SEQ ID NO: 170241 - DNA, 717 bp, Homo sapiens
  Payload ID: 13527
  Gene Symbol: PSMD6
  Gene Name: proteasome 26S subunit, non-ATPase 6
  ENST ID: ENST00000497323
  CDS Start-End: 40-717
ccaagttgtgtcctgtcagccgctgtccccttcgccgcgatgccgctggagaacctggaggaggaggacttttggaacagaatccggcaagagcaaaccgaggattgccctccctccagccctagtagaggttggcattgccaggattggccgtcacgcaaacctcccaccagcatacgtttatgttttgccaagccgattattaagcgccatcgcatgccttcctacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaa

SEQ ID NO: 170242 - DNA, 1176 bp, Homo sapiens
  Payload ID: 13527
  Gene Symbol: PSMD6
  Gene Name: proteasome 26S subunit, non-ATPase 6
  Uniprot ID: Q15008
  ENST ID: ENST00000482510
  CDS Start-End: 40-1092
ccaagttgtgtcctgtcagccgctgtccccttcgccgcgatgccgctggagaacctggaggaggaggacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagct

SEQ ID NO: 170243 - DNA, 1670 bp, Homo sapiens
  Payload ID: 13528
  Gene Symbol: PSMD7
  Gene Name: proteasome 26S subunit, non-ATPase 7
  Uniprot ID: P51665
  ENST ID: ENST00000219313
  CDS Start-End: 141-1115
gggagcggaagaaggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaa

SEQ ID NO: 170244 - DNA, 931 bp, Homo sapiens
  Payload ID: 13528
  Gene Symbol: PSMD7
  Gene Name: proteasome 26S subunit, non-ATPase 7
  ENST ID: ENST00000568615
  CDS Start-End: 87-620
gggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacggtgagaccctagtacagcatcaaaatcattcactgcccgagaggtcacacagtgtaaggaagaggtctgtgtcgggaatatggagacctggggtctcgtcctggccgtccactaacaagtctgccattctgagcaaatcacagtccctttccagacctttgttttattgtctgtaaattgaagtgtttgaactacatcaactgtaaaatgtcttgagttacaatttatgactttgtggatagcataccttgtctggaaactataatgttgactgacgggaagagaggtatgaaataaatgcaggcctgcactctc

SEQ ID NO: 170245 - DNA, 1395 bp, Homo sapiens
  Payload ID: 13528
  Gene Symbol: PSMD7
  Gene Name: proteasome 26S subunit, non-ATPase 7
  ENST ID: ENST00000568717
  CDS Start-End: 96-227
agaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgggtttcgccatgttgcccacgctgcccatgctcgtctcaaactcctgagctcaagtgatctgcccacctcagcctctcgaagtgctgggattacaggcatgagccactgcatccggcctactccatcatctttattccaaaaaagatttcaggatgggaaaagtttaaagaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgt

SEQ ID NO: 170246 - DNA, 692 bp, Homo sapiens
  Payload ID: 13528
  Gene Symbol: PSMD7
  Gene Name: proteasome 26S subunit, non-ATPase 7
  ENST ID: ENST00000567958
  CDS Start-End: 95-691
gaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgctgcaggacgtcttcaacctgctgccagatgtcagcctgcaggagttcgtcaaggccttttacctgaa

SEQ ID NO: 170247 - DNA, 1553 bp, Homo sapiens
  Payload ID: 13529
  Gene Symbol: PSMD8
  Gene Name: proteasome 26S subunit, non-ATPase 8
  Uniprot ID: P48556
  ENST ID: ENST00000215071
  CDS Start-End: 67-1119
agttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 170248 - DNA, 1581 bp, Homo sapiens
  Payload ID: 13529
  Gene Symbol: PSMD8
  Gene Name: proteasome 26S subunit, non-ATPase 8
  ENST ID: ENST00000592035
  CDS Start-End: 643-1161
gctacgaggtgtctggacccaaccaagtcccgggccgcggaagccacctcggtgccagcgagactgaggcgggctgggggatccgatggggtgaaagatttggaacagccaaagtgggggctcggagggcgtcaagaagcgagagagggacagggagcgttgatggtcacgcctgtaatcgcagcgctttgggaggccgaggcgggggagcgtcgcttgagcccaggagttcaagatcagcctgagcaacatagcgagactctgtctctacattttttttttaagtgagagatgactggaatggacccacgcgggggtggtgggggaatgattggaagacttatggcagaactgagtgaggggttagatttttggtgcgtggaggcttaactggtcggagtggcaggattgggattcgggcttttcctgatggtggattccaggcaagaccaagtgggaagtgaggactgcccggagtgataaaagaatgaggctgaaaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaaggtggctggggtacagggcaaggggccgtgggaccaaggggtgaagtcactaacaacagtgtggggtggcttagagggacactggaacaagactgcccaggtttaagttcaactgtgtgactctaggcaagctgccaaagctctctgacatcagtttctctatccacagaatggggctagatacatgggatgagcttagtacctggcagcagctggaggtgggcgctgcacgcatgttggctgctgtctttatcaaaatttcttagaggtggcagctttttctgcaagactttgcttcatttggtctcaggcgtttgagcacgagcaacgcttggtgttgcaggaggagggctgggaccaggctatggaaggtgaaattgggctgggtgcagtggctcccgcgcaccaaggtggatcctcccacctaggctcactctgggaggctgaggtgggaggatcgcctgaggtcaggagttcgagaccagcctggtcaacatggtgaaacctcatctctactaaaaaatac

SEQ ID NO: 170249 - DNA, 771 bp, Homo sapiens
  Payload ID: 13529
  Gene Symbol: PSMD8
  Gene Name: proteasome 26S subunit, non-ATPase 8
  ENST ID: ENST00000592561
  CDS Start-End: 20-771
gcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaaggtggctggggtacagggcaaggggcc

SEQ ID NO: 170250 - DNA, 422 bp, Homo sapiens
  Payload ID: 13529
  Gene Symbol: PSMD8
  Gene Name: proteasome 26S subunit, non-ATPase 8
  ENST ID: ENST00000590331
  CDS Start-End: 1-192
tacctgatggagggcagctacaacaaagtgttcctggccaagggtaacatccccgccgagagctacaccttcttcattgacatcctgctcgacactatcagtgaattgggcctggtcatgggattgtggataacggctctcatctcaccacccttggctgttgacatgtgtggccacgtgtgtcaaacctgagcatggaattggttcagcaggcagggattgtgcggcctgtcttagcccatcttccgtcctagatacccatccaggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagc

SEQ ID NO: 170251 - DNA, 541 bp, Homo sapiens
  Payload ID: 13529
  Gene Symbol: PSMD8
  Gene Name: proteasome 26S subunit, non-ATPase 8
  ENST ID: ENST00000585598
  CDS Start-End: 34-423
aaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgagtgtcactggggtgaaattgggctgggtgcagtggctcccgcgcaccaaggtggatcctcccacctaggctcactctgggaggctgaggtgggaggatcgcctgaggtcaggagttcgagaccagcctggtcaacatggtgaaacctcatctctactaaaaaatacaaaaaaaattagccggatgtggtggcgggtgcctgtaatctcagctactcgggaggctgaggcaggagaattgcttgaacccaggagggtggag

SEQ ID NO: 170252 - DNA, 578 bp, Homo sapiens
  Payload ID: 13529
  Gene Symbol: PSMD8
  Gene Name: proteasome 26S subunit, non-ATPase 8
  ENST ID: ENST00000591250
  CDS Start-End: 378-578
tcggtgccagcgagactgaggcgggctgggggatccgatggggtgaaagatttggaacagccaaagtgggggctcggagggcgtcaagaagcgagagagggacagggagcgttgatggtcacgcctgtaatcgcagcgctttgggaggccgaggcgggggagcgtcgcttgagcccaggagttcaagatcagcctgagcaacatagcgagactctgtctctacattttttttttaactagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaa

SEQ ID NO: 170253 - DNA, 1330 bp, Homo sapiens
  Payload ID: 13529
  Gene Symbol: PSMD8
  Gene Name: proteasome 26S subunit, non-ATPase 8
  ENST ID: ENST00000602911
  CDS Start-End: 33-896
aatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 170254 - DNA, 1538 bp, Homo sapiens
  Payload ID: 13529
  Gene Symbol: PSMD8
  Gene Name: proteasome 26S subunit, non-ATPase 8
  Uniprot ID: P48556
  ENST ID: ENST00000620216
  CDS Start-End: 53-1105
ccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatg

SEQ ID NO: 170255 - DNA, 2307 bp, Homo sapiens
  Payload ID: 13530
  Gene Symbol: PSMD9
  Gene Name: proteasome 26S subunit, non-ATPase 9
  ENST ID: ENST00000261817
  CDS Start-End: 87-755
catgggcggagccgtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtattttccagtctcttttataaagtctcagactataataaacacagcttgcccagtt

SEQ ID NO: 170256 - DNA, 2784 bp, Homo sapiens
  Payload ID: 13530
  Gene Symbol: PSMD9
  Gene Name: proteasome 26S subunit, non-ATPase 9
  Uniprot ID: O00233
  ENST ID: ENST00000541212
  CDS Start-End: 127-798
gactgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtattttccagtctcttttataaagtctcagactataataaacacagcttgcccagtttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattg

SEQ ID NO: 170257 - DNA, 1001 bp, Homo sapiens
  Payload ID: 13530
  Gene Symbol: PSMD9
  Gene Name: proteasome 26S subunit, non-ATPase 9
  ENST ID: ENST00000543699
  CDS Start-End: 13-552
ccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcggtaatccaggggttggccactcaagtccatgcccaggggacacgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctgg

SEQ ID NO: 170258 - DNA, 793 bp, Homo sapiens
  Payload ID: 13530
  Gene Symbol: PSMD9
  Gene Name: proteasome 26S subunit, non-ATPase 9
  ENST ID: ENST00000540962
  CDS Start-End: 96-353
gttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattcc

SEQ ID NO: 170259 - DNA, 534 bp, Homo sapiens
  Payload ID: 13530
  Gene Symbol: PSMD9
  Gene Name: proteasome 26S subunit, non-ATPase 9
  ENST ID: ENST00000538613
  CDS Start-End: 74-534
gtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcggtaatcca

SEQ ID NO: 170260 - DNA, 516 bp, Homo sapiens
  Payload ID: 13530
  Gene Symbol: PSMD9
  Gene Name: proteasome 26S subunit, non-ATPase 9
  Uniprot ID: O00233
  ENST ID: ENST00000542602
  CDS Start-End: 72-428
agttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagcggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaag

SEQ ID NO: 170261 - DNA, 1773 bp, Homo sapiens
  Payload ID: 13530
  Gene Symbol: PSMD9
  Gene Name: proteasome 26S subunit, non-ATPase 9
  ENST ID: ENST00000535293
  CDS Start-End: 938-1324
ggttctgggggttagctcgtggttatctgtttttgggggccgctcttcaacccactatgctgtgtatgcgcgtggcatgtgctaagtactctgcaggtcagctcgttagttcttgcagcaggtagggagggaggcgagtgctcctattcccattttataattgaggaagctgaggcttagagaggagaaggtctcagctaaggatgcccagcttgtacatggcagagttgagattcaaattaaagtctaaccaattgcaaagcccctcccctgaaccatgtgactggtttcactgcttttgtgtactctcctctgactcatgttaaaaaaaaaaaaagtgttgttttgaataaagaatacattcccataggcaaaattcaaaacctacagaggggtataaaatggactgtctctctccctgccctgtcacctagccacccagttcttctccccggaggcagctggtgctatcagtttccttcttcagatctttttattttcagaagaatcaaagccctgccacagctgggtgctgtctgggcttttcactcccctctagcttccagggccagcagccaggtgtcagccacctgtgggaaggagggtgtgaaggagtggaggaagaggctggccttggggatgatgctcaaaggagtctttggttttatcggcactgttttaacttcaaaaaagaatggattcatgcattacttgcgtcgttaaaaataaaaaatgaaaaacacagtgcccaccccagggtagttgtgagggcatgagtagagcccctggtgtaagtgatcagtatgtggcagttttcattactgtcacctttattatgacttcagaggagaagggtctggggaaagacatcctggggacattacacccatgagcaccttttaaccacgtttctttcctccagcaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcggtaatccaggggttggccactcaagtccatgcccaggggacacgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctgg

SEQ ID NO: 170262 - DNA, 1195 bp, Homo sapiens
  Payload ID: 13530
  Gene Symbol: PSMD9
  Gene Name: proteasome 26S subunit, non-ATPase 9
  Uniprot ID: O00233
  ENST ID: ENST00000537407
  CDS Start-End: 126-755
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgagggggccctggcacccaccatcctactttctgtctctatgaatttgactactccagggacctcatctagaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatga

SEQ ID NO: 170263 - DNA, 1006 bp, Homo sapiens
  Payload ID: 13531
  Gene Symbol: PSME1
  Gene Name: proteasome activator subunit 1
  Uniprot ID: Q06323
  ENST ID: ENST00000206451
  CDS Start-End: 106-855
actacccaggaaggcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcccatca

SEQ ID NO: 170264 - DNA, 1136 bp, Homo sapiens
  Payload ID: 13531
  Gene Symbol: PSME1
  Gene Name: proteasome activator subunit 1
  Uniprot ID: Q06323
  ENST ID: ENST00000382708
  CDS Start-End: 64-816
ttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgtgaggaggcaagggcagggcaggggtgggcagaggcagctttcccaggccacccactccctgaccctgcaggctaggggttaagggtgacaaagctcagcttctccacaaggctagaaatggggcacagagccactggaggcctctgactgacctctactccctggccctgtaggctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgccca

SEQ ID NO: 170265 - DNA, 1033 bp, Homo sapiens
  Payload ID: 13531
  Gene Symbol: PSME1
  Gene Name: proteasome activator subunit 1
  ENST ID: ENST00000559123
  CDS Start-End: 618-890
ccaggaaggcggagctgggtgcgagcgccctaccgctttcgctttcccttcgcggtgcccactccactccttgtgcggcgctaggccccccgtcccggtcatggccatgctcagggtccagcccgaggcccaagccaaggtgagcgccgcggggtctagaaagggcccactggggaggcgtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccact

SEQ ID NO: 170266 - DNA, 651 bp, Homo sapiens
  Payload ID: 13531
  Gene Symbol: PSME1
  Gene Name: proteasome activator subunit 1
  ENST ID: ENST00000558112
  CDS Start-End: 1-345
aaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtggtagggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccact

SEQ ID NO: 170267 - DNA, 945 bp, Homo sapiens
  Payload ID: 13531
  Gene Symbol: PSME1
  Gene Name: proteasome activator subunit 1
  Uniprot ID: Q06323
  ENST ID: ENST00000561435
  CDS Start-End: 37-738
cactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgtgaggaggctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcccatca

SEQ ID NO: 170268 - DNA, 1404 bp, Homo sapiens
  Payload ID: 13532
  Gene Symbol: PSME2
  Gene Name: proteasome activator subunit 2
  Uniprot ID: Q9UL46
  ENST ID: ENST00000216802
  CDS Start-End: 641-1360
ctggaccagtccggtacgctccgggcctcaccgaggaagtcccaccctgcaggggaaccgactctggccggccctaacccctctcgagcgagtcccgccccatctccggtctgtcctgaaggcagagggaagaccctcacccaacccctgcccgctctcttctaagagctgctagtccttctccaccccaggcgctccctctggctgcccctcccactcgctctgatctctctccgtccgctacttgcggtcgagccttcttgggggagccccgccactgaataccccctttgccatactcccacctctcttaccccaaccctggacttccagttggccctagctataagccccgcccctctccgagggacagcccccgctccagtctccgcggtcccacttaccctagcccctccctcgggcagcccctggactgtgacccagccagcaccgcctctcctagtggcaactggctgggaatggctgaggggctacctactgcttgcggcctgccagcgggaggaggggggcggaaagaagaaagggggcggggttgaggggggcgggcctggacctggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 170269 - DNA, 512 bp, Homo sapiens
  Payload ID: 13532
  Gene Symbol: PSME2
  Gene Name: proteasome activator subunit 2
  ENST ID: ENST00000559056
  CDS Start-End: 258-512
ggcaccctgttgtgggtggaagcttttgacaacccagacccttaaccaacatccgggtactgctctctgtgtaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagaca

SEQ ID NO: 170270 - DNA, 620 bp, Homo sapiens
  Payload ID: 13532
  Gene Symbol: PSME2
  Gene Name: proteasome activator subunit 2
  ENST ID: ENST00000560370
  CDS Start-End: 11-157
ctgaagcagcatggccaagccgtgtggggtgcgcctgagcggggaagcccgcaaacaggtggaggtcttcagacagaatcttttccaggagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagg

SEQ ID NO: 170271 - DNA, 1502 bp, Homo sapiens
  Payload ID: 13532
  Gene Symbol: PSME2
  Gene Name: proteasome activator subunit 2
  ENST ID: ENST00000558273
  CDS Start-End: 655-774
ctttctttttctagctggaccagtccggtacgctccgggcctcaccgaggaagtcccaccctgcaggggaaccgactctggccggccctaacccctctcgagcgagtcccgccccatctccggtctgtcctgaaggcagagggaagaccctcacccaacccctgcccgctctcttctaagagctgctagtccttctccaccccaggcgctccctctggctgcccctcccactcgctctgatctctctccgtccgctacttgcggtcgagccttcttgggggagccccgccactgaataccccctttgccatactcccacctctcttaccccaaccctggacttccagttggccctagctataagccccgcccctctccgagggacagcccccgctccagtctccgcggtcccacttaccctagcccctccctcgggcagcccctggactgtgacccagccagcaccgcctctcctagtggcaactggctgggaatggctgaggggctacctactgcttgcggcctgccagcgggaggaggggggcggaaagaagaaagggggcggggttgaggggggcgggcctggacctggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtcttcagtttcctcatttgcaagtcttggacccagtgatttccaaaggcccttccagttccatttgtcagacatctcattgagcatattctgtgattcccctcccttgcaatgtaacccacaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaaccc

SEQ ID NO: 170272 - DNA, 755 bp, Homo sapiens
  Payload ID: 13532
  Gene Symbol: PSME2
  Gene Name: proteasome activator subunit 2
  ENST ID: ENST00000560410
  CDS Start-End: 25-711
cagagatctagcgactgaagcagcatggccaagccgtgtggggtgcgcctgagcggggaagcccgcaaacaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 170273 - DNA, 874 bp, Homo sapiens
  Payload ID: 13532
  Gene Symbol: PSME2
  Gene Name: proteasome activator subunit 2
  ENST ID: ENST00000615264
  CDS Start-End: 66-830
tggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaaggtaagagagataagagaaagggcctgaatcccctctttctcacagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 170274 - DNA, 185 bp, Homo sapiens
  Payload ID: 13532
  Gene Symbol: PSME2
  Gene Name: proteasome activator subunit 2
  ENST ID: ENST00000630027
  CDS Start-End: 66-185
tggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtcttcagtttcctcatttgcaagtcttggacccagtga

SEQ ID NO: 170275 - DNA, 3144 bp, Homo sapiens
  Payload ID: 13533
  Gene Symbol: PSME3
  Gene Name: proteasome activator subunit 3
  Uniprot ID: P61289
  ENST ID: ENST00000293362
  CDS Start-End: 162-965
gggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacgccttcaggcaaaggtcctcatatatgttttgacctccaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttg

SEQ ID NO: 170276 - DNA, 2944 bp, Homo sapiens
  Payload ID: 13533
  Gene Symbol: PSME3
  Gene Name: proteasome activator subunit 3
  Uniprot ID: P61289
  ENST ID: ENST00000441946
  CDS Start-End: 509-1306
gaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaagctctgagcttccgctcggctcagcccagcccccaactcccggggtcggcttcgcgggagaggaaaatataggatggctttctgtaccgcgtctgatgatggagagtcccggggacacctccgcggacacgtgttggactcagggctttaggcccgtgacagctgacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaa

SEQ ID NO: 170277 - DNA, 956 bp, Homo sapiens
  Payload ID: 13533
  Gene Symbol: PSME3
  Gene Name: proteasome activator subunit 3
  ENST ID: ENST00000543428
  CDS Start-End: 188-580
aagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctg

SEQ ID NO: 170278 - DNA, 3366 bp, Homo sapiens
  Payload ID: 13533
  Gene Symbol: PSME3
  Gene Name: proteasome activator subunit 3
  ENST ID: ENST00000541124
  CDS Start-End: 491-1186
ggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgc

SEQ ID NO: 170279 - DNA, 3082 bp, Homo sapiens
  Payload ID: 13533
  Gene Symbol: PSME3
  Gene Name: proteasome activator subunit 3
  ENST ID: ENST00000545225
  CDS Start-End: 840-1421
aagtgtaggagccaaggccgcagagaatggggaggctccgctattctctaaattcagggggcggcgggcgcggtggctcacgcctgtaatctcagcacttggggaggccgaggagggcggatcacgtgaggtcaggagttcgagaccagcctggccaacacagtgaaaccccgtctctactaaaaatacaaaaactagccgggcgtggtggggcacgcctataatcccagcttaatcccagctactcgggaggctgaggcaggagaatcgcttgaacctgggaggtggaggttgcagtgagccgagatcgggccactgcactccagcctgggcgacagggcaaggctccatctcagaacaacaacagcaacaacaaaaggccgggcatggtggctcacgcttgtaattccagcactttgggaggccgaggcgggcggatcacaaggctggagtgaagcggaacaaacaaacatggctcactgcagatttgacttcctggctcaagcaatcctcttgcttcaacctccagtgtagcagggaccacagcatgaaagcccctttaggggaggtgactggaatcatccccaaagaattctcacctagtcctggtgtggctgcttcatagtcctgcgtttcttcctgcttggctgtccctaacatctcagaaacgcatagagaagtaacgggcttctagagaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttct

SEQ ID NO: 170280 - DNA, 752 bp, Homo sapiens
  Payload ID: 13533
  Gene Symbol: PSME3
  Gene Name: proteasome activator subunit 3
  ENST ID: ENST00000586312
  CDS Start-End: 84-212
gatttctcaggtccctccggccccctccctggagtccacagcgcctccggtgtccagaggatcggacacggcccggcccggccatggcctcgttgctgaaggtggatcaggaagtgaagctcaagacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttga

SEQ ID NO: 170281 - DNA, 1018 bp, Homo sapiens
  Payload ID: 13533
  Gene Symbol: PSME3
  Gene Name: proteasome activator subunit 3
  ENST ID: ENST00000591152
  CDS Start-End: 663-1018
aaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggtagcggcaccggtccggcctttttgcccctcgctttgatcccccagcagtctgaccggcttcctactccccatggcgtctttgtctccctggggataccagctctgagcttccgctcggctcagcccagcccccaactcccggggtcggcttcgcgggagaggaaaatataggatggctttctgtaccgcgtctgatgatggagagtcccggggacacctccgcggacacgtgttggactcagggctttaggcccgtgacagctggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttc

SEQ ID NO: 170282 - DNA, 1364 bp, Homo sapiens
  Payload ID: 13533
  Gene Symbol: PSME3
  Gene Name: proteasome activator subunit 3
  ENST ID: ENST00000585805
  CDS Start-End: 1075-1364
gagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggtagcggcaccggtccggcctttttgcccctcgctttgatcccccagcagtctgaccggcttcctactccccatggcgtctttgtctccctggggataccagctctgagcttccgctcggctcagcccagcccccaactcccggggtcggcttcgcgggagaggaaaatataggatggctttctgtaccgcgtctgatgatggagagtcccggggacacctccgcggacacgtgttggactcagggctttaggcccgtgacagctggtaatcccccagcccaacaacgtccctggacactgcccctgcccttggcggctggcctgcctagtatcatagactaggtctgggtgggggttggcacgtttgtgagctcacatcttccctaactacctgtcttttgtctgcttatcaaattcagacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggtgagggaaagacagttggattgggattctccatcctgctcttacctctgtccccaggtactgaattgctctctttgttaattttaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattca

SEQ ID NO: 170283 - DNA, 998 bp, Homo sapiens
  Payload ID: 13533
  Gene Symbol: PSME3
  Gene Name: proteasome activator subunit 3
  Uniprot ID: P61289
  ENST ID: ENST00000590720
  CDS Start-End: 234-998
agtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactga

SEQ ID NO: 170284 - DNA, 733 bp, Homo sapiens
  Payload ID: 13533
  Gene Symbol: PSME3
  Gene Name: proteasome activator subunit 3
  ENST ID: ENST00000589469
  CDS Start-End: 196-733
gagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggaggaaacagttgcagagctaagaactgttgagagtgaagctgcatcttatctggaccagatttctagatattatattacaagagccaaattggtttctaaaatagctaaatatccccatgtggaggactatc

SEQ ID NO: 170285 - DNA, 580 bp, Homo sapiens
  Payload ID: 13533
  Gene Symbol: PSME3
  Gene Name: proteasome activator subunit 3
  ENST ID: ENST00000586114
  CDS Start-End: 249-580
agtttccggcgtgagcggcgaaagccgggagggcgagcgagagagcaagcaggcagcaggctgccggcgggcgggcggacggcacagagggagggagcgagcgagcagttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagc

SEQ ID NO: 170286 - DNA, 826 bp, Homo sapiens
  Payload ID: 13533
  Gene Symbol: PSME3
  Gene Name: proteasome activator subunit 3
  ENST ID: ENST00000592169
  CDS Start-End: 137-733
cgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgagcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggct

SEQ ID NO: 170287 - DNA, 3183 bp, Homo sapiens
  Payload ID: 13533
  Gene Symbol: PSME3
  Gene Name: proteasome activator subunit 3
  ENST ID: ENST00000622892
  CDS Start-End: 491-1003
ggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgc

SEQ ID NO: 170288 - DNA, 6581 bp, Homo sapiens
  Payload ID: 13534
  Gene Symbol: PSME4
  Gene Name: proteasome activator subunit 4
  ENST ID: ENST00000389993
  CDS Start-End: 57-1772
ggtgggggccggggagggttcgggtgggagggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacaggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctgaaaattattatacttcacctaaatggaagactgctgtgtttgtggaaattttgtaattttttaatttattttattctctctccctttttattttgcctgcagaatcgttgagagactaataaggcttaatatttaattgatttgtttaatatgttatataaatgtaaaagagtgtataaactgtagagatagcattggcaagacattgtacagatgcaaccttttacacaacatcattgtgtaatttgtaaagattcacgtgtagttctttattatagtgattttgggctttgtacccactgaatgccattttttgtgtttttaaattattttctttatcttgttacaaaaactgagatgtggggtttttttttttt

SEQ ID NO: 170289 - DNA, 7099 bp, Homo sapiens
  Payload ID: 13534
  Gene Symbol: PSME4
  Gene Name: proteasome activator subunit 4
  Uniprot ID: Q14997
  ENST ID: ENST00000404125
  CDS Start-End: 57-5588
ggtgggggccggggagggttcgggtgggagggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctgaaaattattatacttcacctaaatggaagactgctgtgtttgtggaaattttgtaattttttaatttattttattctctctccctttttattttgcctgcagaatcgttgagagactaataaggcttaatatttaattgatttgtttaatatgttatataaatgtaaaagagtgtataaactgtagagatagcattggcaagacattgtacagatgcaaccttttacacaacatcattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaagcacagcagtggtcctggtacagtatttaagtgtcggcatacacaggcgtaatccctgtataaagtagtgccaaactgatttcagttgtgtaactagtttaaaacccaataaatggattctttttaaca

SEQ ID NO: 170290 - DNA, 2042 bp, Homo sapiens
  Payload ID: 13535
  Gene Symbol: PSMF1
  Gene Name: proteasome inhibitor subunit 1
  ENST ID: ENST00000246015
  CDS Start-End: 177-968
ttccggcttccccgccccgccccgtccccgggcgtctccattttggtctcaggtgtggactcggcaagaaccagcgcaagagggaagcagagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagatggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgacctgttc

SEQ ID NO: 170291 - DNA, 3686 bp, Homo sapiens
  Payload ID: 13535
  Gene Symbol: PSMF1
  Gene Name: proteasome inhibitor subunit 1
  Uniprot ID: Q92530
  ENST ID: ENST00000333082
  CDS Start-End: 169-984
agccaagttctttccatcatcctgggccctcacctctggcataggctcttggtagtgggggcccagacagggaggcacctgccacctgcttcccttctcagccacccacagccctcatagggcagaatgggactcttgctgatgtagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagatggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgacctgttcctccttttttaaatagcagctttattgagatataatttacatacccataatttacatacctgtttaaagtatacaattcagtggatttagtatgttcacagtgttgcacatccaccaccatttctaattcctgaacattttcaccacctcaaaaagaaaccacacacccattggcatgactccccattcccttgctcccagccccaggcaaccactaacatctgtctctaaagattttttttttttttctggacagttctcataagtggaatcactcagtattatggccttttgtgtctggcttctttcatttcatgtgatgttttcaagattcattcatgctgtagcatgtatccatggtatggatatatcacattttgcttatccttttatcagttgatggacagttgggttgtttctacaaaaaggctattatgagtaatgcagccaagaa

SEQ ID NO: 170292 - DNA, 4290 bp, Homo sapiens
  Payload ID: 13535
  Gene Symbol: PSMF1
  Gene Name: proteasome inhibitor subunit 1
  Uniprot ID: Q92530
  ENST ID: ENST00000335877
  CDS Start-End: 177-992
ttccggcttccccgccccgccccgtccccgggcgtctccattttggtctcaggtgtggactcggcaagaaccagcgcaagagggaagcagagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagatggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgacctgttcctccttttttaaatagcagctttattgagatataatttacatacccataatttacatacctgtttaaagtatacaattcagtggatttagtatgttcacagtgttgcacatccaccaccatttctaattcctgaacattttcaccacctcaaaaagaaaccacacacccattggcatgactccccattcccttgctcccagccccaggcaaccactaacatctgtctctaaagattttttttttttttctggacagttctcataagtggaatcactcagtattatggccttttgtgtctggcttctttcatttcatgtgatgttttcaagattcattcatgctgtagcatgtatccatggtatggatatatcacattttgcttatccttttatcagttgatggacagttgggttgtttctacaaaaaggctattatgagtaatgcagccaagaacatttgtgtaccagtttttgagttttcagttgtttgagtttcagatgttttcagttcatttgggtatataccaaggagtggaattgctggttcacatggtagctctatattctactttgtgaggaattgtcagactgttttccacggaagctgcaccattttacatttccactggtaatttatgagggttccagtttccccacatcttcaccaactcttgttatttttcatgcttatggccatcctagttagcgtgaagtagcatctcattgtggtcttctcttccattttttaaaaaagaattttgacctacaccaagcaaggcagagaccagagtcagtcccccttggggagcaatctgtggttttgataatcaccaccttgggatgaacatggctggtgagctgcagagcagttgatttgacttttggggatggttctaggctggatgtgatacagggcaggttttgtctctagagaaagttctcatgaccttcaggtctaatgagattcagatcatcactttggtttggtttgaaatttctttgtttatccagtgaattacaagtagaataaagatctggttctaaattgtc

SEQ ID NO: 170293 - DNA, 642 bp, Homo sapiens
  Payload ID: 13535
  Gene Symbol: PSMF1
  Gene Name: proteasome inhibitor subunit 1
  ENST ID: ENST00000381898
  CDS Start-End: 1-384
cacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggggaacacacgccaaccccagagacagctttggtctgaatcgtgcaggttccgggaagacacggtgaccagctgaatcgtgtggtctcgctgcagtctagtcatcagataaacatcagacaaatcccaatgaagaaaattctacaaaacatctgactagttctcctcaaaggtcatcaaaacaaggaaagtctgagaaattgtcacaaacgataggaacctaaaaagacataacgactcaatgtagtgtggtacccttgatagaatactggaacaggaaaaggaaattttgcaaaaactatggaaatataaataaagtatggactttagctaa

SEQ ID NO: 170294 - DNA, 704 bp, Homo sapiens
  Payload ID: 13535
  Gene Symbol: PSMF1
  Gene Name: proteasome inhibitor subunit 1
  ENST ID: ENST00000381899
  CDS Start-End: 154-704
atcatcctgggccctcacctctggcataggctcttggtagtgggggcccagacagggaggcacctgccacctgcttcccttctcagccacccacagccctcatagggcagaatgggactcttgctgatgtagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctg

SEQ ID NO: 170295 - DNA, 319 bp, Homo sapiens
  Payload ID: 13535
  Gene Symbol: PSMF1
  Gene Name: proteasome inhibitor subunit 1
  ENST ID: ENST00000435720
  CDS Start-End: 1-319
tatccatgagcagtgggaaaaggctaatgtaagcagtccccaccgggagttcccccctgctaccgccagagaggtggacccactccggattcctccacaccacccacacaccagtcggcagcctccctggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggc

SEQ ID NO: 170296 - DNA, 1330 bp, Homo sapiens
  Payload ID: 13536
  Gene Symbol: POMP
  Gene Name: proteasome maturation protein
  Uniprot ID: Q9Y244
  ENST ID: ENST00000380842
  CDS Start-End: 82-507
gccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacatttttagaacattagtgaatggatcatcttttacaattaaaagtatattttgattatcagtttcttaggaa

SEQ ID NO: 170297 - DNA, 1505 bp, Homo sapiens
  Payload ID: 13537
  Gene Symbol: PSMA1
  Gene Name: proteasome subunit alpha 1
  Uniprot ID: P25786
  ENST ID: ENST00000396394
  CDS Start-End: 398-1189
agtatcacccagagtcacggctgttgactcggacgactttagatgcagcccgccagcgggagaaactggagggaatccgccatacacaggaacctagaagggctacgtgacaggggctgccccgcagctctcagccgccggcactcccagccaggttttcccgccagtctcagttcctagatcttccgaggctccgcccgccgccgagcggtcggaaagttttaaggagggggaagtgttgcaagcctatcgatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggta

SEQ ID NO: 170298 - DNA, 1266 bp, Homo sapiens
  Payload ID: 13537
  Gene Symbol: PSMA1
  Gene Name: proteasome subunit alpha 1
  Uniprot ID: P25786
  ENST ID: ENST00000418988
  CDS Start-End: 329-1138
cgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttgtatgttggtctactaggtgactgtctcctggaaatgttatgcagctcagcaaggtgaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtc

SEQ ID NO: 170299 - DNA, 588 bp, Homo sapiens
  Payload ID: 13537
  Gene Symbol: PSMA1
  Gene Name: proteasome subunit alpha 1
  ENST ID: ENST00000532256
  CDS Start-End: 583-588
gtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccaggtttgtgttcctggacagcgtccgttttcctgtttcgaaatcagtatgacaatgatgtcactgtttggagcccccagggcaggattcatcaaattgaatatgcaatggaa

SEQ ID NO: 170300 - DNA, 571 bp, Homo sapiens
  Payload ID: 13537
  Gene Symbol: PSMA1
  Gene Name: proteasome subunit alpha 1
  ENST ID: ENST00000533068
  CDS Start-End: 529-571
gatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccagtttcgaaatcagtatgacaatgatgtcactgtttggagcccccagggcaggattcatcaaattgaatatgcaatggaagctgttaaacaaggttcagccacagttggtctgaaat

SEQ ID NO: 170301 - DNA, 1527 bp, Homo sapiens
  Payload ID: 13537
  Gene Symbol: PSMA1
  Gene Name: proteasome subunit alpha 1
  ENST ID: ENST00000530457
  CDS Start-End: 532-1248
tttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaa

SEQ ID NO: 170302 - DNA, 1487 bp, Homo sapiens
  Payload ID: 13538
  Gene Symbol: PSMA2
  Gene Name: proteasome subunit alpha 2
  Uniprot ID: P25787
  ENST ID: ENST00000223321
  CDS Start-End: 66-770
ggaaatgaaaggaaatcggccacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaactat

SEQ ID NO: 170303 - DNA, 4251 bp, Homo sapiens
  Payload ID: 13538
  Gene Symbol: PSMA2
  Gene Name: proteasome subunit alpha 2
  ENST ID: ENST00000411875
  CDS Start-End: 15-83
ctcttcgggtaaagatggcggagcgcgggtacagcttttcgctgactacattcagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaaggtaggcctactcattgtaactgcattctttagcaaactcactttatggtttttggtgctctttaagtaaattaatatcatgggactaaagaaacttgctatattactctgtatatgaatctagttacagataaaccaaaaacttctctcccttctagtttcctagacttcagtatattaagtggtaattaatattcatttcctaaggagttctctttctacattctatggtttcctaaatgcttttggtttttttactttttacttcactttttgtgccatttcaggagggaaaaaaaagaacattgaatctggaataaaacatttggggagacaaatttttaaatgatttaatgataacagtttacgacagtaaaaaaaattgtgaaaccaaatgcctggagttgaaggtatattaaatatttgatacatgtgcttgataaaaagtggagcactatgtaaaaatctgtcggtgcccaagtacaagctgctcttacttatttccagctgtattctagtctcagtgttactgtagtccttcgggactctccaagcttttgaagaagaaaatgttttatttcttgatatgtaatagttgcacatatttttgcagtacatgtgatattttgatacctgtatacagtgtcaaatcagggtaattggatatccattacctcaaacatctgtcttttctttgtgttgggaacatagcagatcttctagctgttctgaaatatacagtaaattgttaacgataatttcctgactgtactactggacaccagaacttattcctcctgtctgaccgtatttttagaccccttaaccaacttccttcagttcttcttcccttctcccttcccagcctctggtaaccactgtgctactctctccctccatgagatccacttttttagctcccacatatgagtgacaacatgcaatatttatctttctgtgcctggcttattttgcttaacgtaatgacctcgagttccatccatgttgctgcaaatgacaggatttcatttttttatggctgaataataataaaaaacttcgtaactccgtttaacagatgagccttcacagtacatttttcacgtaacgttaaggttattaaaaatcttaggcctggatttaaatggtaaacttaatcttaggctcttaaagcactttttcatttttcttttatatattaatgagtcttccaaagatttcacattgttattacatgatatgttatgatttgttttattttttgtttcagaggcattttatttagacaactaaaaataattagatgttcagaaccagtgtacaatgaaagaaattaaaccagttactttatcatgtattccctctttacaaccaaagcaaaaaacaatagcaacaaagacattctgctttaagggaaaagtcagacaaataagccaatatatttttcttctccataatgacataaacagctgcaagaactcttaattgtaataagagaagttggatgttatcttgtacatattcattaaaaagatgacaggccattgtactacaagaggataactcaacctcccttcatctgatactcttgagatttcacttatgggtaacaccatgttagttgtttcagcaatggagctaattcatattcctcattatttattgctgtttttgccttaagcagagagtaactctggaaggctgatgcttttctctgcttgctcgttctagtccagttgtatgctgtctgtggcacatgcttgatgttcaggccttaacttgaggagttgaagaatagatggaatctgaattctctgaagcaatttcttctagctcttctcttgtctttggaaaaccaatctttggctttgccagctcaccagtatcttcttcaggaagcacacatttccaaaggccatatgtttttcctaccacagtttgccagtctcagtgttccatcttcagaaccactggcatagagttctccatcaggatcaaatctcacacagtgaataggaccagagtgtcctttgtaggattctaattcttctccactattatcatcatacttataagtttaacatcttcaccacctgcaacaagaaattctttctcaaggtgaagagattcagagttaatgtttgcaggagcttgaaaggatttaattggttccaaacttactgtactgtcaaaagcactggatcagccataagttattaccaaaatctctccctcagaaatatattccatactactagccaacataataaaatttagagatttcacttctgtcatagtagcatgatcccaaagtcttaacagttttgtcatcagaagaaagaatctgtttatcctcactgtaccatagggcctttttaatatcagagctgtgatcactaatttcctcaggttctgcttcgggtttgttcaagtcatatatgcaaaacagtttattctgtcccctggttaacaaataattactatcctgcatgaaatccatagtcttgataatgtgtttatgagccagggtcatcagttcatctcctgggatagcatcccacactttgtgaaatctgcagctgctgtggctgctttggtggcatccttattcagtgttgcattccagacagcatctttatgacccaaaattgttccaatccagtctcctgtatctccctggcatagcataggtttgccgtctttgcaagcactgatttagaaatactcataagactggccaggcgcagtggctcacgcctgtaatcccagcactttgggaggccaaggcaggcggatcacctgaggtcagaagttcgagaccagctgggccaacatggtgaaaccccgtctctactaaaaatacaaaaattagccaggagtgatagcgcgcgcctgtaatcccagctactcgggaggctgaggcaggagaatcacttgaacctgggaggcggagtttgcagtgagccaagattgcaccactgcactccagcctgggcgacagagcaagattctgtcttgagggaaaaaaaagcccctaaggcatgatgccactgaaggccaagtcagccacgggccatatgtggccagaacaggtgagcagcatcagtctcattgctatggaggtggtgaacccagtgattgggctggtgggctgagggtcatccttgtcttttctcctctggtacagcgcccggggttcctccaggcttcaccctaacacgggctgagcagagaaaaaggaaaaggtggcaccgagattaggaaggagctagggaggggctggggagtctgggaagggtgagcaacagttgacaatggagggaggaaagtaggggatggggagaaccgaagaaacgacccagccactcttcgcaccgtccacactggtatcggcaggaagtgacatgttatgttttaacttataagaaaaagattttagcaaagttctgatttttctgtgttttaaaaattataataatgccaccacatcctgattgttaaaatatttatacttaagaagtttcctggctgggtgtgttggctcgtgcctgtaatcccagcactttggtaggtcaaggcaggcggatcacgaggtcaggagatcgagaccatcctggctgacacagtgaaacccatctctactaaaaatacaaagaaattagctgggcgtagtgggcgcctgtagtcccagctacttgggaggctgaggcaggagaatggcatgagcccgggaggtggagcttgcagtaagccaagataactgtgtctcaaaaaaaaaaaaaaaa

SEQ ID NO: 170304 - DNA, 683 bp, Homo sapiens
  Payload ID: 13538
  Gene Symbol: PSMA2
  Gene Name: proteasome subunit alpha 2
  ENST ID: ENST00000445517
  CDS Start-End: 28-522
ggctgtgctttggctcttcgggtaaagatggcggagcgcgggtacagcttttcgctgactacattcagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaaccc

SEQ ID NO: 170305 - DNA, 1453 bp, Homo sapiens
  Payload ID: 13538
  Gene Symbol: PSMA2
  Gene Name: proteasome subunit alpha 2
  ENST ID: ENST00000436986
  CDS Start-End: 1-56
cggagcgcgggtacagcttttcgctgactacattcagcttcttacagatgaactaaccgcagcttgtacaaattaaacaacttgtctaaggtcatcgcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaat

SEQ ID NO: 170306 - DNA, 801 bp, Homo sapiens
  Payload ID: 13538
  Gene Symbol: PSMA2
  Gene Name: proteasome subunit alpha 2
  ENST ID: ENST00000457444
  CDS Start-End: 1-111
ttaagcccgtctggtaaacttgtccagattgaatatgctttggctgctgtagctggaggagccccgtccgtgggaattaaagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatga

SEQ ID NO: 170307 - DNA, 970 bp, Homo sapiens
  Payload ID: 13539
  Gene Symbol: PSMA3
  Gene Name: proteasome subunit alpha 3
  Uniprot ID: P25788
  ENST ID: ENST00000216455
  CDS Start-End: 91-858
agcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataacta

SEQ ID NO: 170308 - DNA, 908 bp, Homo sapiens
  Payload ID: 13539
  Gene Symbol: PSMA3
  Gene Name: proteasome subunit alpha 3
  Uniprot ID: P25788
  ENST ID: ENST00000412908
  CDS Start-End: 45-791
gctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaa

SEQ ID NO: 170309 - DNA, 363 bp, Homo sapiens
  Payload ID: 13539
  Gene Symbol: PSMA3
  Gene Name: proteasome subunit alpha 3
  ENST ID: ENST00000553677
  CDS Start-End: 1-252
catcttgcagacagagtggccatgtatgtgcatgcatatacactctacagtgctgttagaccttttggctgcagaatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataact

SEQ ID NO: 170310 - DNA, 654 bp, Homo sapiens
  Payload ID: 13539
  Gene Symbol: PSMA3
  Gene Name: proteasome subunit alpha 3
  ENST ID: ENST00000557087
  CDS Start-End: 56-166
ataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtaggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaag

SEQ ID NO: 170311 - DNA, 814 bp, Homo sapiens
  Payload ID: 13539
  Gene Symbol: PSMA3
  Gene Name: proteasome subunit alpha 3
  ENST ID: ENST00000557508
  CDS Start-End: 160-702
cctttgggtttagcacgatgagctcaatcggcactgggtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataacta

SEQ ID NO: 170312 - DNA, 606 bp, Homo sapiens
  Payload ID: 13539
  Gene Symbol: PSMA3
  Gene Name: proteasome subunit alpha 3
  ENST ID: ENST00000555931
  CDS Start-End: 49-213
aagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgtta

SEQ ID NO: 170313 - DNA, 4411 bp, Homo sapiens
  Payload ID: 13540
  Gene Symbol: PSMA4
  Gene Name: proteasome subunit alpha 4
  Uniprot ID: P25789
  ENST ID: ENST00000044462
  CDS Start-End: 151-936
aacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaataaattctctgtagcagtaattgttaaatatacaaaaactgacagggcgattactttttgcacattgtggcttacagtcctttcacaaagatgggcacgttcctcaggctggccagattattcgtctctgtctgcaggaattggtttgagaatgaacacgtgagctgaacaaagccagaattgatgtgtgggtgtggatctcgcagctaggactgaggctgcccacaggcagcagctcaagctgcgcggaagatgaggtgtagaagttaaggccacagaggaaaagtggaaccaagagatgagaacagttacgtgttggctgaagggagctctgttgctggggtttgttcaacctgagttcccttggctatctgtggcttcatgacagaagtgatacagggcagtggtacttaatgcgtagccatggtgctttagcatcacctatgcagattctgatgtcccatcccagatctactgaattaaaatctctgagggtgaaacccagtaatctgttctaacaagctctgcatgtgattcttaggaatgctaagtaaaactttaagaagtttttgttgcatattagaatcacctaggaagcttttgcagcttgtaagcatgctgtatcgattaactcaagctctgtggtggaacccagatattaacattgcttaaactcttcaggtgatttccatcagctagggtgagtgcattgagccatcatttacccttctctcagctgttgtcaaccaaatatgtgctcccagtctaatttctcattgtagattttcttaatgcagctccctgcagttttctgtataggctaaagtatttacaagccctatttgcagcacttttttgaacttctaaattattctcttactctgtacagcaggttctcgttatttttggtagttatgttctaaagtcaccacaaaaactaacaaaatactgaactcttgcacctagagaaagtactgggttagggtcctacaagccactggtcacatttttatcaactgatcagtacataacctgttttttgtgtatttctacttaaagacacctttttaaatgtgtattgtggattcattaacatagaactcagccaacagctctttacgtgaatgtttttgttttgttttgttttttgagactgggtcttgctctgtcacccaggctggagtgcagtggcgtgatcatatttcactgcaggctcaaacggtcttcctgccttgacctcccaaagtgttgacatcacagccctcttatgcttaggaacaacactaaacagtgtttttttcatagagacggtgagcagggaaggtctcaccatgtttcccatgccggtctcaagctcctggactcaagcgatcctcctgcctcagcctcccaaagtgctgacatcacagccctcttgtgcttaggaacattaaacagcacttcagcactatacctgggtgccatttgaaatagtaaaatcactaagaaaaatgcaaaaataaacggcacaaggtagactgcaggaacacttacacggtgtgagagctgaaacaagaattcagagtgtcgccttgctcaacctcagatgggaacatgtgcacctgggtactcaaaattttcaccactctgcatgtcaacaaatgactaaaagtaccacaagtattggtttgggggttacatgtacattttatgagaatgcaaattttgcaaattcacaagtacagaatcagcaagtagtgaagatgaatggcacgtcttcaccctccagtcttgctacacccagaggttgaggtagtcaataaatcttattaactctgtctgcagaatttacccataatccagccactttccactgcaggaacgctggtccaattcaccattatctctgacttggactattgcaacagcctcctaactggttccttgcctccacttcattccccacagtcaattctccagcagcagccacagtgatcctttcaaaatgtaaacggtactactgcacagttttggctcaaaaccctccaatggcttcccatcttgctcagtaagagtcaaattctttgtactggttcatgaggtatcctgtattctggccttgtgctaccttccatgtgcttccttcctcactcattcatccaaatgagccttctcatcattccctgaatgtgccaagctcccctcacatcacttgccaatccctctgccttgggaatgctcttcctgggtatctattgcccactccctcatctccaggtctctgcttgcatgtcaccttttttggggtacttctgtgaaggagcaatctctttcccctgcacactcacattttctattccctatacataccctgttgagtttttctccatagcactcatcaccagctggcatatttgtttcttgtctctccccactggaatacagacttccagagcagtactttgttttcattcaatagtcgtgtctcggtacctagaacagaaactggcacgtgttaggcaacaaataagtactgatgaatgaataaataccctggatatgctggtgtgaaatcctaaaaaatacctgctttccatccagatcagtagcactggtggattttctgtatcctgactaccccttcaacatttgcctaaagctaggacaacttcttcaaaggcaatagtgaataagagagcctggtatagtttgccgccacattaggaaagtcttcagaatttgaccctaacagcaggcaaatttcaacgtattcatctttttgttgaaataaattcatactgtgaggaaaagcaaaagataggaggtgaggcaaaagctactctttaactgtgagttttttttccttgcgatggggtttggctgcctagtctagattctcacgctagccccactttcgtctgctctgtggcatatttttaacctgagttgcaggacaggtggtttccagagtgttgcctgatgcatcccaaatgctgccttagcaatacacatctgaacaggggcccatcactaatagcaagcatttcattaatctgagcaaaactcatgggttttcacagggaccctaccagctcagaagcacgttgatataaataagtagaaaaccaaagacagctaagttttaaatcttgagtcaaaactttaaaatcaaagtcaaattgatttcattttggtgagctttcaaatcatgcttttaaaaataaattatgtaaaaaaatc

SEQ ID NO: 170314 - DNA, 1019 bp, Homo sapiens
  Payload ID: 13540
  Gene Symbol: PSMA4
  Gene Name: proteasome subunit alpha 4
  Uniprot ID: P25789
  ENST ID: ENST00000413382
  CDS Start-End: 187-759
gcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaataaa

SEQ ID NO: 170315 - DNA, 637 bp, Homo sapiens
  Payload ID: 13540
  Gene Symbol: PSMA4
  Gene Name: proteasome subunit alpha 4
  ENST ID: ENST00000559154
  CDS Start-End: 271-637
ggcattagccactgcacctggcctagttttgatgtttctaaggagagctcacttttgcaaagattaaagtcattaaaaatctttgaattgaaaattacagatttttttcaaccaaacttacaaaatattatttactatgagaatattcagatgttgacttgttccctccccttcaaattacaaatgactgttaggttgtccccatggcatagattgcttttcagagaatattttccttagagtctgtctgtgttttagagaaaactactaatgtgcccatctctttatcctaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaag

SEQ ID NO: 170316 - DNA, 710 bp, Homo sapiens
  Payload ID: 13540
  Gene Symbol: PSMA4
  Gene Name: proteasome subunit alpha 4
  ENST ID: ENST00000559948
  CDS Start-End: 166-710
gcgcatgcgcgggggccatattagcagcggttattcggtgagcggtggtggtttattcttccgtggagttaagggctccgtggacatctcaggtcttcagggtcttccatctggaactatataaagttcagaaaacatggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaact

SEQ ID NO: 170317 - DNA, 815 bp, Homo sapiens
  Payload ID: 13540
  Gene Symbol: PSMA4
  Gene Name: proteasome subunit alpha 4
  ENST ID: ENST00000560737
  CDS Start-End: 106-815
ccacattataatctatgactgcctctctcacctaactgccagtattagcttttcaggacaggaactggttttacacattttggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgat

SEQ ID NO: 170318 - DNA, 773 bp, Homo sapiens
  Payload ID: 13540
  Gene Symbol: PSMA4
  Gene Name: proteasome subunit alpha 4
  ENST ID: ENST00000558281
  CDS Start-End: 86-610
tttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgcttggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttgg

SEQ ID NO: 170319 - DNA, 719 bp, Homo sapiens
  Payload ID: 13540
  Gene Symbol: PSMA4
  Gene Name: proteasome subunit alpha 4
  ENST ID: ENST00000558341
  CDS Start-End: 46-423
ggcttccgtcctcaggagttcggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaa

SEQ ID NO: 170320 - DNA, 756 bp, Homo sapiens
  Payload ID: 13540
  Gene Symbol: PSMA4
  Gene Name: proteasome subunit alpha 4
  ENST ID: ENST00000559437
  CDS Start-End: 128-756
ttagctctcccggaggtgccggtgaactcaaaatagtgctgtgcccggcgtcaggcgtggagacaacagaaagttgtgcttaaagctcgaatcagaaatccccggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaa

SEQ ID NO: 170321 - DNA, 674 bp, Homo sapiens
  Payload ID: 13540
  Gene Symbol: PSMA4
  Gene Name: proteasome subunit alpha 4
  ENST ID: ENST00000559146
  CDS Start-End: 124-674
ggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgagtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaa

SEQ ID NO: 170322 - DNA, 651 bp, Homo sapiens
  Payload ID: 13540
  Gene Symbol: PSMA4
  Gene Name: proteasome subunit alpha 4
  ENST ID: ENST00000558094
  CDS Start-End: 202-462
tcattaaaaatctttgaattgaaaattacagatttttttcaaccaaacttacaaaatattatttactatgagaatattcagatgttgacttgttccctccccttcaaattacaaatgactgttaggttgtccccatggcatagattgcttttcagagaatattttccttagagtctgtctgtgttttagagaaaactactaatgtgcccatctctttatcctaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgcttggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtc

SEQ ID NO: 170323 - DNA, 786 bp, Homo sapiens
  Payload ID: 13540
  Gene Symbol: PSMA4
  Gene Name: proteasome subunit alpha 4
  ENST ID: ENST00000559365
  CDS Start-End: 125-786
agtgccaagcctggacgccggggcccgcgagggggcgggctgagggtgggggtctgtgggcaggaccgagagttggggtggcttccgtcctcaggagttcggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatgg

SEQ ID NO: 170324 - DNA, 944 bp, Homo sapiens
  Payload ID: 13540
  Gene Symbol: PSMA4
  Gene Name: proteasome subunit alpha 4
  ENST ID: ENST00000560217
  CDS Start-End: 159-851
cccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactgg

SEQ ID NO: 170325 - DNA, 1094 bp, Homo sapiens
  Payload ID: 13540
  Gene Symbol: PSMA4
  Gene Name: proteasome subunit alpha 4
  Uniprot ID: P25789
  ENST ID: ENST00000559082
  CDS Start-End: 67-852
ggttctgcgcatgcgcgggggccatattagcagcggttattcggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaa

SEQ ID NO: 170326 - DNA, 3729 bp, Homo sapiens
  Payload ID: 13541
  Gene Symbol: PSMA5
  Gene Name: proteasome subunit alpha 5
  Uniprot ID: P28066
  ENST ID: ENST00000271308
  CDS Start-End: 22-747
ctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaatatttgttaatagactgttctcttctaatagtcttttttttttttttttttttaagagatgaggtctcactatattgcccaggctggtttcaaactcctgggttcaagtgatcttcccgcctctgcctcctgaagtgctaggattataggcgagagccactgtgcccagccattgtaatacagtcttttgtttgaaatgcaaatgttagtgggccaaaaggacagtgttattaatatccctattctatgaagatgtctgttctaaaactgttttagtgatgctctataacagaatcaactatatccattaatcccatggtgttgataaatgaactagtccagctcttcccagtggttaatagatgttaacagcactgtaaatccatttcggccctataatttctggagcaaacgtgtatttttgctgcttttcttataaggagatgctactaattgactatcagaagaacatgttttgaggtcctcctcaaaacattgatgggttggaatcagccatcaacagtgttgtaccagttcttgggtcttgatagacaatttggaaagagatttccttgtttacgaagtgaaggactaagaattaaattaatgaccttggcctcactggcaatcaattacaaatctctatatcagtaagagaattgtaaaattcagaagcagtttacattagactttggaatgaatgatgaactttccccattagagctgccatcatatgattggtggagattgtttaaagaatcattctatctcagcctcaaaaattaccacgggaagatggtatcagtatcactacttaacagatgaagaatctaatgctgtgtgcccatggacacacaaaattaagctgttgggacttgaacagctcaaattttcttgtttcagatcaccagctcttgagtaatagggaaatctggagatttgaaaagtacttgcactgtccacaacatggctaatccatatgtggatgatgcagaattgatttaattcactaacagggaccccataattatttgctgggctctgggtatattgatgtgtaggaagttgtactatatgttaataaattatgactatttggataggctgaattcatactaaatccatactgtagttcaacaaaaaacaacatgtttatatacatttggaaactgcaatgataggaaacatttggaagaaagggattttgccctagaataacacataaggaaagcagagaattagagtatattgttactgaatgttccagagacttctagtgattttaacacttattaagtatagcatgttgatggggagatttgtttctctaaagatcactttgttttattaaatcctaatagaaaatacccttgaaaatcctatctcatttattcctgtaacaaatttattgagcacctacctactatatgccaagaaatgtattagccatcaggcagagagctgttcaaatggtagatatgatctgtgctcctgtgaaacttctagtggggagagccaaacaataaacaatattcctttttaactctaggttaatgcagaaatggataaagcccatgttgcttttgggagaggtgagttgtgtctctgaatcacatgcatttcatagggggaaaaatgcccaaatactaaggagtagctcttagcctatgtccgttcgcctcagcttaagttgttttccctcccactggctgggcagcatatttgtgttttacctggtaaaacagtaaatttcgtaccttctataattggcattcttcaaagaggtagaactttgatttttttgtagaatattaaaacaagctttcttaggttaaagaagtgatcttactacgaacagcaatggtttcatgatgtgtaattgctttatgttatctttctgctatagaatgtttcctggagaaaggtacggtttttagtaataagataaatttactttagtcctgcaaataaggtgaaatcttatgtccagtatctcacaaaggagaactgacagtgccacttttatatttaatgtcaatctcattagacaaaaatgaaatatagttcctagggtttccaatttaaaaagtgaaataataaatatattcactcaaacattttctcagtgccatatgcaagttaccatgtcccagaagctgatacagtttgaagaaggaaatatataagtactgtaagcctgtgataactaaaagcaacatactaaaaagtgaaggtacagataattggaacaaatttaatagcgtttaaaagtgtatttggtaatttctccaggaggtggcactgttgagttgttttttcttttcagacagtaagacaatagaccattcatctttgtgtcacccaaacaaagaaatattcctttataaccccctttcctccccccacctaatcacatgctactggaactgactgtcttgtgatctactcccatagttggcatagatttaaaaataatcttttttaaattaatctgatagtagttatggaaaggaacaaattgttcaccaattttcatcagctttatcttttcagtccagtaactgagaacttaaaaagactattctagtgattttactatcctgctcagatggcattcaaaaacatttttcacttctcacgtcttggaaaaatttgtaaattcgttaagtctttttgtttgaaagttaatgtgactggaaatattttaatgtaaatatcgggttgggtgcattgtatcattttgctctacaatgactatatcctcatttgggtttatggccagtttataattaaaagtaatctttacttgctttgagtgtaa

SEQ ID NO: 170327 - DNA, 1504 bp, Homo sapiens
  Payload ID: 13541
  Gene Symbol: PSMA5
  Gene Name: proteasome subunit alpha 5
  Uniprot ID: P28066
  ENST ID: ENST00000538610
  CDS Start-End: 953-1504
ccacatcggcggcacttgtcctaccgctgagtcacccctgggtcctaactcggtgcggaagcgagaagctccggctggtgcttggtaaagaaggcgtgaggagccggaactcctaccttgaacccggagaaggccaagggtcactctttgctccgttcatcttttcgtgcctagtatgactgccttgaacaaacaaacaaaaagttaaacgtgcttcctggaagaaaaagcaactggtttgtagtagggcatgctgcggtgtatagtttcttcagaagcgcgaaggcagtcgtagctttggctggatatattgtctggagtctgattttataggaactggaatttagaatggttttcaagagatttctcatcatgccgattccaattgaccaaaattttttctgactttttaaaagtttaaagcaagttttaaaaaacttttgtggtatgaaaatgttcacaatattaagttgtacatatatatgctgtagacatttttactttcagtttctgttttcgtcagttaagtttttacatagctactcttttttaaagtcagggaaggcagacattttctttgtactgagtggtatgagatgctgcatttcctgtcaagtatatgctgatcctgtcgaagttttaccacctgcagttaccactttttcatcttttttactgactcgtagaagatgtgtgtgaagttttgacatatttccccactgtcctataaagtgactttgttggtcgatatttaacttccagaacattgaagagaatcatcttcgggtgacataattttgagttagggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtctatgactttgaaagaagccatcaagtcttcactcatcatcctcaaacaagtaatggaggagaagctgaatgcaacaaacattgagctagccacagtgcagcctggccagaatttccacatgttcacaaaggaagaacttgaagaggttatcaaggacatttaa

SEQ ID NO: 170328 - DNA, 1029 bp, Homo sapiens
  Payload ID: 13542
  Gene Symbol: PSMA6
  Gene Name: proteasome subunit alpha 6
  Uniprot ID: P60900
  ENST ID: ENST00000261479
  CDS Start-End: 121-861
gcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataa

SEQ ID NO: 170329 - DNA, 912 bp, Homo sapiens
  Payload ID: 13542
  Gene Symbol: PSMA6
  Gene Name: proteasome subunit alpha 6
  Uniprot ID: P60900
  ENST ID: ENST00000540871
  CDS Start-End: 68-751
agtgtcctaggctgggagaatgggatggagcctccacctcatgaagtagcttcctttggaggtggctatggcaggtcttcggagagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttgg

SEQ ID NO: 170330 - DNA, 763 bp, Homo sapiens
  Payload ID: 13542
  Gene Symbol: PSMA6
  Gene Name: proteasome subunit alpha 6
  ENST ID: ENST00000556506
  CDS Start-End: 5-616
caacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaagattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcct

SEQ ID NO: 170331 - DNA, 787 bp, Homo sapiens
  Payload ID: 13542
  Gene Symbol: PSMA6
  Gene Name: proteasome subunit alpha 6
  ENST ID: ENST00000553688
  CDS Start-End: 35-238
cagggattgtgtttaaagtagtgcttctaccaacatgtcccgtggttccagcgccggttttgaccgccacattaccattttttcacccgagggtcggctctaccaagtagcatggacttctgtggttaattccacacaggcactcgaagcctgctatataccagacactgctagtcctaggagatacaaatgtgaatgttacaccctcttctatactgaagctcacagcttagagtgacagatacgttaaacaaacggataaaaaaaattaaaagtgccaatttacaaatatctacagagttcaagacatctttgggaatctgatagaatgagtgactcaattctagagctgctcttgagattggcatcccctttttacccacatctgtttgaatgctcctgtaatttaaatgccgattctgagttgtagatgagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtat

SEQ ID NO: 170332 - DNA, 423 bp, Homo sapiens
  Payload ID: 13542
  Gene Symbol: PSMA6
  Gene Name: proteasome subunit alpha 6
  ENST ID: ENST00000556221
  CDS Start-End: 1-257
aaagaattgccgatatttctcaggtctacacacagaatgctgaaatgaggcctcttggttgttgtatgattttaattggtatagatgaagagcaaggccctcagactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaat

SEQ ID NO: 170333 - DNA, 814 bp, Homo sapiens
  Payload ID: 13542
  Gene Symbol: PSMA6
  Gene Name: proteasome subunit alpha 6
  ENST ID: ENST00000554961
  CDS Start-End: 85-531
ctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataa

SEQ ID NO: 170334 - DNA, 790 bp, Homo sapiens
  Payload ID: 13542
  Gene Symbol: PSMA6
  Gene Name: proteasome subunit alpha 6
  ENST ID: ENST00000554620
  CDS Start-End: 85-408
ctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagtctcactttgtcgcccaggctgctccgcctcctgggttcaagcaattctcgtgcctcaacctcccaggtagctgggactacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaat

SEQ ID NO: 170335 - DNA, 925 bp, Homo sapiens
  Payload ID: 13542
  Gene Symbol: PSMA6
  Gene Name: proteasome subunit alpha 6
  ENST ID: ENST00000554541
  CDS Start-End: 129-254
atgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtaggacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaaca

SEQ ID NO: 170336 - DNA, 1002 bp, Homo sapiens
  Payload ID: 13542
  Gene Symbol: PSMA6
  Gene Name: proteasome subunit alpha 6
  Uniprot ID: P60900
  ENST ID: ENST00000555764
  CDS Start-End: 312-815
gtgtttaaagtagtgcttctaccaacatgtcccgtggttccagcgccggttttgaccgccacattaccattttttcacccgagggtcggctctaccaagtaggtgagtgaaccaggttcgcctgtgggccacctgaattgccctgtcatgaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgcatcctgttgttttca

SEQ ID NO: 170337 - DNA, 879 bp, Homo sapiens
  Payload ID: 13542
  Gene Symbol: PSMA6
  Gene Name: proteasome subunit alpha 6
  ENST ID: ENST00000553809
  CDS Start-End: 80-838
acttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttggtcttttctctttttaggtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacct

SEQ ID NO: 170338 - DNA, 978 bp, Homo sapiens
  Payload ID: 13542
  Gene Symbol: PSMA6
  Gene Name: proteasome subunit alpha 6
  Uniprot ID: P60900
  ENST ID: ENST00000622405
  CDS Start-End: 303-806
gctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtaggacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaaaaagtgaagaagaaatttgattggacatttgaacagacagtggaaactgcaattacatgcctgtctactgttctatcaattgatttcaaaccttcagaaatagaagttggagtagtgacagttgaaaatcctaaattcaggattcttacagaagcagagattgatgctcaccttgttgctctagcagagagagactaaacattgtcgttagtttaccagatccgtgatgccacttacctgtgtgtttggtaacaacaaaccaacatcatggaggtccctggattgaaaaaggagcctctcccactcctcctaccaccgaagtggttaggactctatataaataaaaacaaggcttttggaaaataattgc

SEQ ID NO: 170339 - DNA, 364 bp, Homo sapiens
  Payload ID: 13542
  Gene Symbol: PSMA6
  Gene Name: proteasome subunit alpha 6
  ENST ID: ENST00000628955
  CDS Start-End: 161-364
gctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagcatggacttctgtggttaattccacacaggcactcgaagcctgctatataccagacactgctagtcctaggagatacaaatgtgaatgttacaccctcttctatactgaagctcacagcttagagtga

SEQ ID NO: 170340 - DNA, 484 bp, Homo sapiens
  Payload ID: 13542
  Gene Symbol: PSMA6
  Gene Name: proteasome subunit alpha 6
  ENST ID: ENST00000627895
  CDS Start-End: 161-484
gctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagtctcactttgtcgcccaggctgctccgcctcctgggttcaagcaattctcgtgcctcaacctcccaggtag

SEQ ID NO: 170341 - DNA, 925 bp, Homo sapiens
  Payload ID: 13543
  Gene Symbol: PSMA7
  Gene Name: proteasome subunit alpha 7
  Uniprot ID: O14818
  ENST ID: ENST00000370858
  CDS Start-End: 128-577
cagcgcaggacacggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcaggtgggtgcctgcccgcttgcatgctcacctctggcagcagggcagtcacggctccgccatggagggtcctgccatgtcacttcaggtgaatcagaaaactgatttattctggggcgtgatcctaatcttgacttgcacaagtgtaacttgacctagctcaccaatttcagtaacattgttctgttctcagttcctggcatgggatattccaaattcctgtgtctggagggaaatgatagcttttgtcttgccatcctgagtgaccagtcacaaagcagttgaagggggctggaagccaccctatgaggacacgccattagtatgtaagcagaatgtgtgtctacctgtcaaagtaatttccagtaacctgagttcacaattctggtcctaggtgagtttttctaggagtgaaaatgcagaaaaggatgttgaaagctattggctaatgta

SEQ ID NO: 170342 - DNA, 773 bp, Homo sapiens
  Payload ID: 13543
  Gene Symbol: PSMA7
  Gene Name: proteasome subunit alpha 7
  Uniprot ID: O14818
  ENST ID: ENST00000370861
  CDS Start-End: 237-773
ccgcccgggtcaggactggtttggacgcggccgtttcgttttgacgagggctcgtgtacattgaccttagtgacattgtttgaaacttaaattcgtaccatcaagacgtgtcagtttaattggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatga

SEQ ID NO: 170343 - DNA, 996 bp, Homo sapiens
  Payload ID: 13543
  Gene Symbol: PSMA7
  Gene Name: proteasome subunit alpha 7
  Uniprot ID: O14818
  ENST ID: ENST00000370873
  CDS Start-End: 128-874
cagcgcaggacacggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 170344 - DNA, 685 bp, Homo sapiens
  Payload ID: 13543
  Gene Symbol: PSMA7
  Gene Name: proteasome subunit alpha 7
  ENST ID: ENST00000442551
  CDS Start-End: 1-563
gcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaaggaaaggtggttaatgctcctgtcttctgtcccttcaaggtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 170345 - DNA, 1804 bp, Homo sapiens
  Payload ID: 13544
  Gene Symbol: PSMA8
  Gene Name: proteasome subunit alpha 8
  Uniprot ID: Q8TAA3
  ENST ID: ENST00000308268
  CDS Start-End: 90-860
gcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggtaccaatatagttgttcttggggtagaaaaaaaatctgttgccaagcttcaagatgaaagaactgtgaggaaaatttgtgcccttgatgaccatgtctgcatggcttttgcagttttgacaatttttataggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 170346 - DNA, 1675 bp, Homo sapiens
  Payload ID: 13544
  Gene Symbol: PSMA8
  Gene Name: proteasome subunit alpha 8
  Uniprot ID: Q8TAA3
  ENST ID: ENST00000343848
  CDS Start-End: 93-731
cgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 170347 - DNA, 1280 bp, Homo sapiens
  Payload ID: 13544
  Gene Symbol: PSMA8
  Gene Name: proteasome subunit alpha 8
  Uniprot ID: Q8TAA3
  ENST ID: ENST00000415576
  CDS Start-End: 115-867
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggtaccaatatagttgttcttggggtagaaaaaaaatctgttgccaagcttcaagatgaaagaactgtgaggaaaatttgtgcccttgatgaccatgtctgcatggcttttgcaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgca

SEQ ID NO: 170348 - DNA, 1876 bp, Homo sapiens
  Payload ID: 13544
  Gene Symbol: PSMA8
  Gene Name: proteasome subunit alpha 8
  ENST ID: ENST00000538664
  CDS Start-End: 115-306
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcgtatcatgtttctctgattgttcacgattcttgtggcctggcatggatgtctgcacatttgaaaaagtcggaattcgaggtaccaatatagttgttcttggggtagaaaaaaaatctgttgccaagcttcaagatgaaagaactgtgaggaaaatttgtgcccttgatgaccatgtctgcatggcttttgcaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 170349 - DNA, 1619 bp, Homo sapiens
  Payload ID: 13544
  Gene Symbol: PSMA8
  Gene Name: proteasome subunit alpha 8
  ENST ID: ENST00000612461
  CDS Start-End: 1-675
atggatgtctgcacatttgaaaaagtcggaattcgaggtaccaatatagttgttcttggggtagaaaaaaaatctgttgccaagcttcaagatgaaagaactgtgaggaaaatttgtgcccttgatgaccatgtctgcatggcttttgcaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 170350 - DNA, 928 bp, Homo sapiens
  Payload ID: 13545
  Gene Symbol: PSMB1
  Gene Name: proteasome subunit beta 1
  Uniprot ID: P20618
  ENST ID: ENST00000262193
  CDS Start-End: 100-825
agcgaacttcaggagaagccggaagtggcgtaacgtccggtcaaggcagccatctcgccgtgagacagcaagtgtcggatccgcaggcgcagccgtgcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactc

SEQ ID NO: 170351 - DNA, 1218 bp, Homo sapiens
  Payload ID: 13546
  Gene Symbol: PSMB10
  Gene Name: proteasome subunit beta 10
  Uniprot ID: P40306
  ENST ID: ENST00000358514
  CDS Start-End: 339-1160
aagagcaaggggctcagatggagggggaggaggacctgaacaagtccagaagggaagagatttgtccctctatccaacagagtacccagtgagcagcacagagggcacagcaagggacatcacccggttccccaaatgctcagagccacaagtgaagccaaaagtgaaagacaagatgcagaaaaccgccacgggcctttgaggaagggtaaaggcgaaagcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaacaga

SEQ ID NO: 170352 - DNA, 539 bp, Homo sapiens
  Payload ID: 13546
  Gene Symbol: PSMB10
  Gene Name: proteasome subunit beta 10
  ENST ID: ENST00000574576
  CDS Start-End: 1-417
atcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagagaggctgtccctcctccctcccaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaa

SEQ ID NO: 170353 - DNA, 2701 bp, Homo sapiens
  Payload ID: 13547
  Gene Symbol: PSMB2
  Gene Name: proteasome subunit beta 2
  Uniprot ID: P49721
  ENST ID: ENST00000373237
  CDS Start-End: 413-1018
ggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtaaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctaggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaacatta

SEQ ID NO: 170354 - DNA, 4217 bp, Homo sapiens
  Payload ID: 13547
  Gene Symbol: PSMB2
  Gene Name: proteasome subunit beta 2
  ENST ID: ENST00000621781
  CDS Start-End: 240-494
agtactaaccagctatttcatagctgttgcatgaggaaagggactagagtaggattgtacccctcagtctatgctttgtttactctgagtgtacaaaagatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtaaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctaggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaacattagatttgggtgtcttatacactatttaatacgccaatgataaatgccttacaccataagaagaaagctaatcattgagtaaatgggagaaaagagatgattcacgtcactacagttgattcaacctccaacaccaccatgaatatgcataggtttgagcttttagctagattcctgagtgtaaggcatctattttaaaagtgccacaggttggccgggtgcggtggctcatgcctgtaatcccagcactttggccgcccgccgaggcgggcggatcacctgaggtcaggagttcaagaccagcctggccaacatggtgaaaccccatctctactaaaaaaatatataacaattagccaggcgtggtggcacacgcctgtaaacccaactacttgggaggctgaggcaggagaattgcttgagcccgggagagggaggttgcagtgagccgagatcatgccactgcactccagcctggctgacagagcaagactctgtctcaaaaaaaaaaaaaaaaaaaaaaaaaaagcgccacagatgattctgacgccctacccagtggagtgctgctactaaagcacagactatcctgctacatgattttcccatctgtacaatgactgaaatagcacctattctatgtggtagatatgagaattccatgaagtaatataggtaaacatttagttcagggcttggcatgtggtaagtgctcagtaagtgtataatgattggtaaacttgttattctgcattcaggcctcaccagggatgacatacggttctctgcctttgaatgtaagtgtccccagggcaatctcaggcaagcctgcaaacccatcctgactctcagtgtttttttgccaatctggatctctttcctgagctccaaatcaactcattcctagatagctcaccctccagatttagggacatcgaactcagtatgtctaaagctgagccttaccatctgcccctctccaaaccgcctctatgacattctgtcttagagaattagagctacctggtttcccaagtgcccaagtcagaaacccaggcatcatttatttttaataaatgttttattttggaataaatttggttttacagaaaagttgcaaagataatatggtgtccttataccccttattcagtttctgtaatgttaacatcttctatataccacagtatgtttgtcaaaactgagaaaccaacattggttggtgtattagtattactaagctccaggctttattcagattttaccagtttttccactaattttcttctgttctaggatataatccaagatacaacattgcatttagctgggcatcatttttatgccattctttatctcctgtctctacatggccaccaagttctggcatttctacatcctaaatcttttaattttattataattttttattgttgtttttcagagacagggtcttgctccatcacctaggctggagtacagtggcacgatcgtagcttactgcagtaagttcacttgaactcctgggctcaagtgaacctcttaccccagcctcccaactagctgggactagaggggtgcaccactgcacccagctaattttgtcaaaattttttgtagagacagggtctcgccatgttgcctaggctggtctcgaactcttggcctcaagtgatcctcccaccttggtctgccaaagcactgggattacagatgtgagccactgcacccagcctaatctttataaatctccatccccattactctggttcaccccctatcgtttcttagactatttaacagcctcctaacttcactctacttttaatctcttccctctccaggtctttctccatattttaaaaaactagtttcaccatccattcctctctgcccttaaaactttctggtggttttccatggcttaagagaataaagcccaattctttgatttgacatgctaggcattccataatcctctccgaacctaactccccacttcctttccctcctttacacctcataaagcctgtgttccaact

SEQ ID NO: 170355 - DNA, 510 bp, Homo sapiens
  Payload ID: 13548
  Gene Symbol: PSMB3
  Gene Name: proteasome subunit beta 3
  ENST ID: ENST00000610434
  CDS Start-End: 74-510
gagagcggttgcgcagtgaaggctagacccggtttactggaattgctctggcgatcgagggatcctatctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaat

SEQ ID NO: 170356 - DNA, 662 bp, Homo sapiens
  Payload ID: 13548
  Gene Symbol: PSMB3
  Gene Name: proteasome subunit beta 3
  ENST ID: ENST00000613870
  CDS Start-End: 64-387
gaaggctagacccggtttactggaattgctctggcgatcgagggatcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacgacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 170357 - DNA, 552 bp, Homo sapiens
  Payload ID: 13548
  Gene Symbol: PSMB3
  Gene Name: proteasome subunit beta 3
  ENST ID: ENST00000620309
  CDS Start-End: 55-393
acccggtttactggaattgctctggcgatcgagggatcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 170358 - DNA, 773 bp, Homo sapiens
  Payload ID: 13548
  Gene Symbol: PSMB3
  Gene Name: proteasome subunit beta 3
  Uniprot ID: P49720
  ENST ID: ENST00000619426
  CDS Start-End: 92-709
gagacagcagtgagagcggttgcgcagtgaaggctagacccggtttactggaattgctctggcgatcgagggatcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcactcctg

SEQ ID NO: 170359 - DNA, 773 bp, Homo sapiens; identical to SEQ ID NO: 170358
  Payload ID: 13548
  Gene Symbol: PSMB3
  Gene Name: proteasome subunit beta 3
  Uniprot ID: P49720
  ENST ID: ENST00000619951
  CDS Start-End: 92-709

SEQ ID NO: 170360 - DNA, 510 bp, Homo sapiens; identical to SEQ ID NO: 170355
  Payload ID: 13548
  Gene Symbol: PSMB3
  Gene Name: proteasome subunit beta 3
  ENST ID: ENST00000632832
  CDS Start-End: 74-510

SEQ ID NO: 170361 - DNA, 662 bp, Homo sapiens; identical to SEQ ID NO: 170356
  Payload ID: 13548
  Gene Symbol: PSMB3
  Gene Name: proteasome subunit beta 3
  ENST ID: ENST00000631787
  CDS Start-End: 64-387

SEQ ID NO: 170362 - DNA, 552 bp, Homo sapiens; identical to SEQ ID NO: 170357
  Payload ID: 13548
  Gene Symbol: PSMB3
  Gene Name: proteasome subunit beta 3
  ENST ID: ENST00000631987
  CDS Start-End: 55-393

SEQ ID NO: 170363 - DNA, 964 bp, Homo sapiens
  Payload ID: 13549
  Gene Symbol: PSMB4
  Gene Name: proteasome subunit beta 4
  Uniprot ID: P28070
  ENST ID: ENST00000290541
  CDS Start-End: 55-849
acttccgcttccgttggcgcaagcgctttcattttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatgcttgctga

SEQ ID NO: 170364 - DNA, 796 bp, Homo sapiens
  Payload ID: 13550
  Gene Symbol: PSMB5
  Gene Name: proteasome subunit beta 5
  ENST ID: ENST00000334454
  CDS Start-End: 5-238
agacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggtgtggagccagcccccttgccaggctgagtactgaacgcccgcgacttgcctggcctcccagcctgaccggagtttgcggtggccttggccaccaacccaggcggaggctgggtcctctcgttcggaccgcagcagttttgctgtctcattggcccaggaggcccctgtctttgctctggttggaaagggtggcggtggggccggggttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcata

SEQ ID NO: 170365 - DNA, 1294 bp, Homo sapiens
  Payload ID: 13550
  Gene Symbol: PSMB5
  Gene Name: proteasome subunit beta 5
  Uniprot ID: P28074
  ENST ID: ENST00000361611
  CDS Start-End: 265-1056
aggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaatctca

SEQ ID NO: 170366 - DNA, 900 bp, Homo sapiens
  Payload ID: 13550
  Gene Symbol: PSMB5
  Gene Name: proteasome subunit beta 5
  Uniprot ID: P28074
  ENST ID: ENST00000425762
  CDS Start-End: 231-713
cttctcaaagatggccgacctcacttcccttacgcaacatggacgttttcagtcacttcctgtgattttgaggttattctgatccaggactacttgcatgaccaaagccaagatggcagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactat

SEQ ID NO: 170367 - DNA, 729 bp, Homo sapiens
  Payload ID: 13550
  Gene Symbol: PSMB5
  Gene Name: proteasome subunit beta 5
  ENST ID: ENST00000460922
  CDS Start-End: 14-268
gcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactc

SEQ ID NO: 170368 - DNA, 444 bp, Homo sapiens
  Payload ID: 13550
  Gene Symbol: PSMB5
  Gene Name: proteasome subunit beta 5
  ENST ID: ENST00000555895
  CDS Start-End: 1-356
caggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggttgaaagaagctcaaaggcaagaatgttacttttgaattcccaaagtttcaattgtaaacaaaaatgactaaataaaatatcattcacagtt

SEQ ID NO: 170369 - DNA, 1117 bp, Homo sapiens
  Payload ID: 13550
  Gene Symbol: PSMB5
  Gene Name: proteasome subunit beta 5
  Uniprot ID: P28074
  ENST ID: ENST00000493471
  CDS Start-End: 10-621
acactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctgtgtctgaagttctgtgcttgaaacctaagtcatttggaatgtacttgttttgtgggtgtgctgagaggatcggcaacatggcaaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactc

SEQ ID NO: 170370 - DNA, 852 bp, Homo sapiens
  Payload ID: 13551
  Gene Symbol: PSMB6
  Gene Name: proteasome subunit beta 6
  Uniprot ID: P28072
  ENST ID: ENST00000270586
  CDS Start-End: 52-771
gtgacagagcgctttacgacagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagaatctttgta

SEQ ID NO: 170371 - DNA, 583 bp, Homo sapiens
  Payload ID: 13551
  Gene Symbol: PSMB6
  Gene Name: proteasome subunit beta 6
  ENST ID: ENST00000571309
  CDS Start-End: 1-309
accttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgc

SEQ ID NO: 170372 - DNA, 871 bp, Homo sapiens
  Payload ID: 13551
  Gene Symbol: PSMB6
  Gene Name: proteasome subunit beta 6
  ENST ID: ENST00000614486
  CDS Start-End: 52-693
gtgacagagcgctttacgacagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctttcttcttttatccacagctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagaatctttgt

SEQ ID NO: 170373 - DNA, 980 bp, Homo sapiens
  Payload ID: 13552
  Gene Symbol: PSMB7
  Gene Name: proteasome subunit beta 7
  Uniprot ID: Q99436
  ENST ID: ENST00000259457
  CDS Start-End: 15-848
gctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctg

SEQ ID NO: 170374 - DNA, 650 bp, Homo sapiens
  Payload ID: 13552
  Gene Symbol: PSMB7
  Gene Name: proteasome subunit beta 7
  ENST ID: ENST00000441097
  CDS Start-End: 20-650
gaactgctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatggtccattgtgaagaggagctctttacagagaatcttttctttattaggcaagctgaagtagtgtcagaagaagcttggggaccatcttttgctattagcttggcagtgttccttgtagcag

SEQ ID NO: 170375 - DNA, 1351 bp, Homo sapiens
  Payload ID: 13553
  Gene Symbol: PSMB8
  Gene Name: proteasome subunit beta 8
  Uniprot ID: P28062
  ENST ID: ENST00000374881
  CDS Start-End: 291-1109
gaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 170376 - DNA, 1124 bp, Homo sapiens
  Payload ID: 13553
  Gene Symbol: PSMB8
  Gene Name: proteasome subunit beta 8
  Uniprot ID: P28062
  ENST ID: ENST00000374882
  CDS Start-End: 52-882
gctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 170377 - DNA, 1124 bp, Homo sapiens; identical to SEQ ID NO: 170376
  Payload ID: 13553
  Gene Symbol: PSMB8
  Gene Name: proteasome subunit beta 8
  Uniprot ID: P28062
  ENST ID: ENST00000383236
  CDS Start-End: 52-882

SEQ ID NO: 170378 - DNA, 1351 bp, Homo sapiens; identical to SEQ ID NO: 170375
  Payload ID: 13553
  Gene Symbol: PSMB8
  Gene Name: proteasome subunit beta 8
  Uniprot ID: P28062
  ENST ID: ENST00000383238
  CDS Start-End: 291-1109

SEQ ID NO: 170379 - DNA, 1025 bp, Homo sapiens
  Payload ID: 13553
  Gene Symbol: PSMB8
  Gene Name: proteasome subunit beta 8
  ENST ID: ENST00000395339
  CDS Start-End: 25-783
cagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattaactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 170380 - DNA, 1025 bp, Homo sapiens; identical to SEQ ID NO: 170379
  Payload ID: 13553
  Gene Symbol: PSMB8
  Gene Name: proteasome subunit beta 8
  ENST ID: ENST00000399630
  CDS Start-End: 25-783

SEQ ID NO: 170381 - DNA, 1351 bp, Homo sapiens; identical to SEQ ID NO: 170375
  Payload ID: 13553
  Gene Symbol: PSMB8
  Gene Name: proteasome subunit beta 8
  Uniprot ID: P28062
  ENST ID: ENST00000436627
  CDS Start-End: 291-1109

SEQ ID NO: 170382 - DNA, 1025 bp, Homo sapiens; identical to SEQ ID NO: 170379
  Payload ID: 13553
  Gene Symbol: PSMB8
  Gene Name: proteasome subunit beta 8
  ENST ID: ENST00000446855
  CDS Start-End: 25-783

SEQ ID NO: 170383 - DNA, 1124 bp, Homo sapiens; identical to SEQ ID NO: 170376
  Payload ID: 13553
  Gene Symbol: PSMB8
  Gene Name: proteasome subunit beta 8
  Uniprot ID: P28062
  ENST ID: ENST00000429645
  CDS Start-End: 52-882

SEQ ID NO: 170384 - DNA, 1025 bp, Homo sapiens
  Payload ID: 13553
  Gene Symbol: PSMB8
  Gene Name: proteasome subunit beta 8
  ENST ID: ENST00000449883
  CDS Start-End: 25-783
cagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgaagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattaactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 170385 - DNA, 1351 bp, Homo sapiens; identical to SEQ ID NO: 170375
  Payload ID: 13553
  Gene Symbol: PSMB8
  Gene Name: proteasome subunit beta 8
  Uniprot ID: P28062
  ENST ID: ENST00000416134
  CDS Start-End: 291-1109

SEQ ID NO: 170386 - DNA, 1025 bp, Homo sapiens; identical to SEQ ID NO: 170379
  Payload ID: 13553
  Gene Symbol: PSMB8
  Gene Name: proteasome subunit beta 8
  ENST ID: ENST00000458543
  CDS Start-End: 25-783

SEQ ID NO: 170387 - DNA, 1124 bp, Homo sapiens; identical to SEQ ID NO: 170376
  Payload ID: 13553
  Gene Symbol: PSMB8
  Gene Name: proteasome subunit beta 8
  Uniprot ID: P28062
  ENST ID: ENST00000421445
  CDS Start-End: 52-882

SEQ ID NO: 170388 - DNA, 1124 bp, Homo sapiens; identical to SEQ ID NO: 170376
  Payload ID: 13553
  Gene Symbol: PSMB8
  Gene Name: proteasome subunit beta 8
  Uniprot ID: P28062
  ENST ID: ENST00000438442
  CDS Start-End: 52-882

SEQ ID NO: 170389 - DNA, 1025 bp, Homo sapiens; identical to SEQ ID NO: 170379
  Payload ID: 13553
  Gene Symbol: PSMB8
  Gene Name: proteasome subunit beta 8
  ENST ID: ENST00000425784
  CDS Start-End: 25-783

SEQ ID NO: 170390 - DNA, 1124 bp, Homo sapiens; identical to SEQ ID NO: 170376
  Payload ID: 13553
  Gene Symbol: PSMB8
  Gene Name: proteasome subunit beta 8
  Uniprot ID: P28062
  ENST ID: ENST00000455660
  CDS Start-End: 52-882

SEQ ID NO: 170391 - DNA, 1124 bp, Homo sapiens
  Payload ID: 13553
  Gene Symbol: PSMB8
  Gene Name: proteasome subunit beta 8
  ENST ID: ENST00000446762
  CDS Start-End: 52-882
gctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgaagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 170392 - DNA, 1025 bp, Homo sapiens; identical to SEQ ID NO: 170379
  Payload ID: 13553
  Gene Symbol: PSMB8
  Gene Name: proteasome subunit beta 8
  ENST ID: ENST00000427919
  CDS Start-End: 25-783

SEQ ID NO: 170393 - DNA, 1351 bp, Homo sapiens; identical to SEQ ID NO: 170375
  Payload ID: 13553
  Gene Symbol: PSMB8
  Gene Name: proteasome subunit beta 8
  Uniprot ID: P28062
  ENST ID: ENST00000441960
  CDS Start-End: 291-1109

SEQ ID NO: 170394 - DNA, 1351 bp, Homo sapiens; identical to SEQ ID NO: 170375
  Payload ID: 13553
  Gene Symbol: PSMB8
  Gene Name: proteasome subunit beta 8
  Uniprot ID: P28062
  ENST ID: ENST00000416564
  CDS Start-End: 291-1109

SEQ ID NO: 170395 - DNA, 1025 bp, Homo sapiens; identical to SEQ ID NO: 170379
  Payload ID: 13553
  Gene Symbol: PSMB8
  Gene Name: proteasome subunit beta 8
  ENST ID: ENST00000447073
  CDS Start-End: 25-783

SEQ ID NO: 170396 - DNA, 1351 bp, Homo sapiens; identical to SEQ ID NO: 170375
  Payload ID: 13553
  Gene Symbol: PSMB8
  Gene Name: proteasome subunit beta 8
  Uniprot ID: P28062
  ENST ID: ENST00000452573
  CDS Start-End: 291-1109

SEQ ID NO: 170397 - DNA, 1299 bp, Homo sapiens
  Payload ID: 13553
  Gene Symbol: PSMB8
  Gene Name: proteasome subunit beta 8
  Uniprot ID: P28062
  ENST ID: ENST00000435978
  CDS Start-End: 239-1057
agcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaata

SEQ ID NO: 170398 - DNA, 1125 bp, Homo sapiens
  Payload ID: 13553
  Gene Symbol: PSMB8
  Gene Name: proteasome subunit beta 8
  Uniprot ID: P28062
  ENST ID: ENST00000457261
  CDS Start-End: 52-882
gctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatac

SEQ ID NO: 170399 - DNA, 782 bp, Homo sapiens
  Payload ID: 13554
  Gene Symbol: PSMB9
  Gene Name: proteasome subunit beta 9
  Uniprot ID: P28065
  ENST ID: ENST00000374859
  CDS Start-End: 70-729
gcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 170400 - DNA, 782 bp, Homo sapiens; identical to SEQ ID NO: 170399
  Payload ID: 13554
  Gene Symbol: PSMB9
  Gene Name: proteasome subunit beta 9
  Uniprot ID: P28065
  ENST ID: ENST00000383114
  CDS Start-End: 70-729

SEQ ID NO: 170401 - DNA, 782 bp, Homo sapiens; identical to SEQ ID NO: 170399
  Payload ID: 13554
  Gene Symbol: PSMB9
  Gene Name: proteasome subunit beta 9
  Uniprot ID: P28065
  ENST ID: ENST00000383234
  CDS Start-End: 70-729

SEQ ID NO: 170402 - DNA, 792 bp, Homo sapiens
  Payload ID: 13554
  Gene Symbol: PSMB9
  Gene Name: proteasome subunit beta 9
  ENST ID: ENST00000395330
  CDS Start-End: 149-739
ggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 170403 - DNA, 792 bp, Homo sapiens; identical to SEQ ID NO: 170402
  Payload ID: 13554
  Gene Symbol: PSMB9
  Gene Name: proteasome subunit beta 9
  ENST ID: ENST00000399371
  CDS Start-End: 149-739

SEQ ID NO: 170404 - DNA, 640 bp, Homo sapiens
  Payload ID: 13554
  Gene Symbol: PSMB9
  Gene Name: proteasome subunit beta 9
  ENST ID: ENST00000399381
  CDS Start-End: 3-539
ggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctacttctactaaaagaagagtatgtggatactttctaagaactcaaaaacgagaaaaccaaaatcagagggtgcatgaatatatgtgcacaggtgagaggtcactatcctcctctccactgctttcttgttcctgaacctgatactttggctccaagccttcagcagcagctaagttcttagccaagctatctgttgccatagcttcagtggtttctgtatcactacatgcatcttc

SEQ ID NO: 170405 - DNA, 792 bp, Homo sapiens; identical to SEQ ID NO: 170402
  Payload ID: 13554
  Gene Symbol: PSMB9
  Gene Name: proteasome subunit beta 9
  ENST ID: ENST00000399607
  CDS Start-End: 149-739

SEQ ID NO: 170406 - DNA, 640 bp, Homo sapiens; identical to SEQ ID NO: 170404
  Payload ID: 13554
  Gene Symbol: PSMB9
  Gene Name: proteasome subunit beta 9
  ENST ID: ENST00000399619
  CDS Start-End: 3-539

SEQ ID NO: 170407 - DNA, 640 bp, Homo sapiens; identical to SEQ ID NO: 170404
  Payload ID: 13554
  Gene Symbol: PSMB9
  Gene Name: proteasome subunit beta 9
  ENST ID: ENST00000445315
  CDS Start-End: 3-539

SEQ ID NO: 170408 - DNA, 782 bp, Homo sapiens
  Payload ID: 13554
  Gene Symbol: PSMB9
  Gene Name: proteasome subunit beta 9
  Uniprot ID: P28065
  ENST ID: ENST00000434471
  CDS Start-End: 70-729
gcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcacatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 170409 - DNA, 439 bp, Homo sapiens
  Payload ID: 13554
  Gene Symbol: PSMB9
  Gene Name: proteasome subunit beta 9
  ENST ID: ENST00000414474
  CDS Start-End: 45-439
gccaggcgagccaggaaggaccagcgggcgaggtgaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatcta

SEQ ID NO: 170410 - DNA, 439 bp, Homo sapiens
  Payload ID: 13554
  Gene Symbol: PSMB9
  Gene Name: proteasome subunit beta 9
  ENST ID: ENST00000455846
  CDS Start-End: 45-439
gccaggcgagccaggaaggaccagcgggcgaggtgaccaccatcatggcagtggagtttgacgggggcgttgtgatgggttctgattcccgagtgtctgcaggcgaggcggtggtgaaccgagtgtttgacaagctgtccccgctgcacgagcacatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatcta

SEQ ID NO: 170411 - DNA, 782 bp, Homo sapiens; identical to SEQ ID NO: 170399
  Payload ID: 13554
  Gene Symbol: PSMB9
  Gene Name: proteasome subunit beta 9
  Uniprot ID: P28065
  ENST ID: ENST00000444284
  CDS Start-End: 70-729

SEQ ID NO: 170412 - DNA, 792 bp, Homo sapiens
  Payload ID: 13554
  Gene Symbol: PSMB9
  Gene Name: proteasome subunit beta 9
  ENST ID: ENST00000434083
  CDS Start-End: 149-739
ggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagaccaccatcatggcagtggagtttgacgggggcgttgtgatgggttctgattcccgagtgtctgcaggcgaggcggtggtgaaccgagtgtttgacaagctgtccccgctgcacgagcacatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 170413 - DNA, 792 bp, Homo sapiens; identical to SEQ ID NO: 170402
  Payload ID: 13554
  Gene Symbol: PSMB9
  Gene Name: proteasome subunit beta 9
  ENST ID: ENST00000451862
  CDS Start-End: 149-739

SEQ ID NO: 170414 - DNA, 439 bp, Homo sapiens; identical to SEQ ID NO: 170409
  Payload ID: 13554
  Gene Symbol: PSMB9
  Gene Name: proteasome subunit beta 9
  ENST ID: ENST00000415658
  CDS Start-End: 45-439

SEQ ID NO: 170415 - DNA, 792 bp, Homo sapiens; identical to SEQ ID NO: 170412
  Payload ID: 13554
  Gene Symbol: PSMB9
  Gene Name: proteasome subunit beta 9
  ENST ID: ENST00000439630
  CDS Start-End: 149-739

SEQ ID NO: 170416 - DNA, 661 bp, Homo sapiens
  Payload ID: 13554
  Gene Symbol: PSMB9
  Gene Name: proteasome subunit beta 9
  ENST ID: ENST00000418861
  CDS Start-End: 25-561
cgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctacttctactaaaagaagagtatgtggatactttctaagaactcaaaaacgagaaaaccaaaatcagagggtgcatgaatatatgtgcacaagtgagaggtcactatcctcctctccactgctttcttgttcctgaacctgatactttggctccaagccttcagcagcagctaagttcttagcaagctatctgttgccatagcttcagtggtttctgtatcactacatgcatcttc

SEQ ID NO: 170417 - DNA, 792 bp, Homo sapiens; identical to SEQ ID NO: 170402
  Payload ID: 13554
  Gene Symbol: PSMB9
  Gene Name: proteasome subunit beta 9
  ENST ID: ENST00000420182
  CDS Start-End: 149-739

SEQ ID NO: 170418 - DNA, 439 bp, Homo sapiens; identical to SEQ ID NO: 170410
  Payload ID: 13554
  Gene Symbol: PSMB9
  Gene Name: proteasome subunit beta 9
  ENST ID: ENST00000419512
  CDS Start-End: 45-439

SEQ ID NO: 170419 - DNA, 792 bp, Homo sapiens; identical to SEQ ID NO: 170412
  Payload ID: 13554
  Gene Symbol: PSMB9
  Gene Name: proteasome subunit beta 9
  ENST ID: ENST00000422904
  CDS Start-End: 149-739

SEQ ID NO: 170420 - DNA, 439 bp, Homo sapiens; identical to SEQ ID NO: 170409
  Payload ID: 13554
  Gene Symbol: PSMB9
  Gene Name: proteasome subunit beta 9
  ENST ID: ENST00000417566
  CDS Start-End: 45-439

SEQ ID NO: 170421 - DNA, 782 bp, Homo sapiens; identical to SEQ ID NO: 170399
  Payload ID: 13554
  Gene Symbol: PSMB9
  Gene Name: proteasome subunit beta 9
  Uniprot ID: P28065
  ENST ID: ENST00000422729
  CDS Start-End: 70-729

SEQ ID NO: 170422 - DNA, 782 bp, Homo sapiens; identical to SEQ ID NO: 170408
  Payload ID: 13554
  Gene Symbol: PSMB9
  Gene Name: proteasome subunit beta 9
  Uniprot ID: P28065
  ENST ID: ENST00000453059
  CDS Start-End: 70-729

SEQ ID NO: 170423 - DNA, 640 bp, Homo sapiens; identical to SEQ ID NO: 170404
  Payload ID: 13554
  Gene Symbol: PSMB9
  Gene Name: proteasome subunit beta 9
  ENST ID: ENST00000448066
  CDS Start-End: 3-539

SEQ ID NO: 170424 - DNA, 439 bp, Homo sapiens; identical to SEQ ID NO: 170409
  Payload ID: 13554
  Gene Symbol: PSMB9
  Gene Name: proteasome subunit beta 9
  ENST ID: ENST00000434587
  CDS Start-End: 45-439

SEQ ID NO: 170425 - DNA, 673 bp, Homo sapiens
  Payload ID: 13554
  Gene Symbol: PSMB9
  Gene Name: proteasome subunit beta 9
  ENST ID: ENST00000425855
  CDS Start-End: 25-561
cgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctacttctactaaaagaagagtatgtggatactttctaagaactcaaaaacgagaaaaccaaaatcagagggtgcatgaatatatgtgcacaagtgagaggtcactatcctcctctccactgctttcttgttcctgaacctgatactttggctccaagccttcagcagcagctaagttcttagcaagctatctgttgccatagcttcagtggtttctgtatcactacatgcatcttcatcatcacccat

SEQ ID NO: 170426 - DNA, 439 bp, Homo sapiens; identical to SEQ ID NO: 170410
  Payload ID: 13554
  Gene Symbol: PSMB9
  Gene Name: proteasome subunit beta 9
  ENST ID: ENST00000438515
  CDS Start-End: 45-439

SEQ ID NO: 170427 - DNA, 439 bp, Homo sapiens; identical to SEQ ID NO: 170409
  Payload ID: 13554
  Gene Symbol: PSMB9
  Gene Name: proteasome subunit beta 9
  ENST ID: ENST00000413480
  CDS Start-End: 45-439

SEQ ID NO: 170428 - DNA, 782 bp, Homo sapiens; identical to SEQ ID NO: 170408
  Payload ID: 13554
  Gene Symbol: PSMB9
  Gene Name: proteasome subunit beta 9
  Uniprot ID: P28065
  ENST ID: ENST00000427870
  CDS Start-End: 70-729

SEQ ID NO: 170429 - DNA, 661 bp, Homo sapiens; identical to SEQ ID NO: 170416
  Payload ID: 13554
  Gene Symbol: PSMB9
  Gene Name: proteasome subunit beta 9
  ENST ID: ENST00000423563
  CDS Start-End: 25-561

SEQ ID NO: 170430 - DNA, 4080 bp, Homo sapiens
  Payload ID: 13555
  Gene Symbol: POT1
  Gene Name: protection of telomeres 1
  Uniprot ID: Q9NUX5
  ENST ID: ENST00000357628
  CDS Start-End: 600-2504
cagtatttcgccaaacctccaggcgccatcagtgtgtgaaccgttacgcagctggtccaccgcgggcggagaacaagcgactatgcccagggatcctgcacgcatgcgtggagctgaaccgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatga

SEQ ID NO: 170431 - DNA, 3950 bp, Homo sapiens
  Payload ID: 13555
  Gene Symbol: POT1
  Gene Name: protection of telomeres 1
  ENST ID: ENST00000393329
  CDS Start-End: 864-2375
gtcagtatttcgccaaacctccaggcgccatcagtgtgtgaaccgttacgcagctggtccaccgcgggcggagaacaagcgactatgcccagggatcctgcacgcatgcgtggagctgaaccgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatg

SEQ ID NO: 170432 - DNA, 806 bp, Homo sapiens
  Payload ID: 13555
  Gene Symbol: POT1
  Gene Name: protection of telomeres 1
  ENST ID: ENST00000446993
  CDS Start-End: 560-806
gaaccgttacgcagctggtccaccgcgggcggagaacaagcgactatgcccagggatcctgcacgcatgcgtggagctgaaccgtcagcgtgcgtgtgacgtcacctgcgcgcccgcctaaactcttcctagggttctttctagagtacggcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcaca

SEQ ID NO: 170433 - DNA, 587 bp, Homo sapiens
  Payload ID: 13555
  Gene Symbol: POT1
  Gene Name: protection of telomeres 1
  ENST ID: ENST00000430927
  CDS Start-End: 1-256
tggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatga

SEQ ID NO: 170434 - DNA, 579 bp, Homo sapiens
  Payload ID: 13555
  Gene Symbol: POT1
  Gene Name: protection of telomeres 1
  ENST ID: ENST00000429326
  CDS Start-End: 30-167
aatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgtt

SEQ ID NO: 170435 - DNA, 542 bp, Homo sapiens
  Payload ID: 13555
  Gene Symbol: POT1
  Gene Name: protection of telomeres 1
  ENST ID: ENST00000436534
  CDS Start-End: 1-415
atgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaaca

SEQ ID NO: 170436 - DNA, 368 bp, Homo sapiens
  Payload ID: 13555
  Gene Symbol: POT1
  Gene Name: protection of telomeres 1
  ENST ID: ENST00000487564
  CDS Start-End: 1-234
aaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggtgatgtatagtaggaaaaaatgttattttatgtttttataaattatagtgatttttgctcatgtaaattttttatatatggttacatgtataggtgatacagtctagaaattatatttatttctttgatttttaagttgtaaaatgtatgttacaataaattattaaaagataaa

SEQ ID NO: 170437 - DNA, 2036 bp, Homo sapiens
  Payload ID: 13555
  Gene Symbol: POT1
  Gene Name: protection of telomeres 1
  ENST ID: ENST00000608057
  CDS Start-End: 12-1034
ctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaaatggagtctcgcttcgtcctccaggctggagttcagtggcacggtctcggctcattgcagcctccacctcctgagttcaagcttctcctgcctcagcctcccaagtagctgggattacaggctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaa

SEQ ID NO: 170438 - DNA, 1827 bp, Homo sapiens
  Payload ID: 13555
  Gene Symbol: POT1
  Gene Name: protection of telomeres 1
  ENST ID: ENST00000607932
  CDS Start-End: 12-1568
ctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaa

SEQ ID NO: 170439 - DNA, 405 bp, Homo sapiens
  Payload ID: 13555
  Gene Symbol: POT1
  Gene Name: protection of telomeres 1
  ENST ID: ENST00000610141
  CDS Start-End: 1-358
tgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagtaaggataatctttaacattgacagtttagttcttgctaaataaaatagttttatcaacataa

SEQ ID NO: 170440 - DNA, 2780 bp, Homo sapiens
  Payload ID: 13555
  Gene Symbol: POT1
  Gene Name: protection of telomeres 1
  ENST ID: ENST00000609106
  CDS Start-End: 757-2499
agagtacgggtgagtgaaatttgtaaggtttggtgtgttcatttgagtgggtgccagacgtaacgggcccgggattgaattagtttagatcaaaatttgatgtaattatcgcagagaaacgctttcttacgagtgtttatctcgagcctgctgtgttcagcatctttcttggtgttttgggagaagcagacaggagttaagtccaagtccccgccctcacagagctcaggtggcttgggggaaggttggtgcgcaaacattaaaattagatatcgacactagtgagtgtccccgtcaagaggtctgtgaaataaggttgagcctacgatgcagaagttaatctcacagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgtaagtatcagaggacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagca

SEQ ID NO: 170441 - DNA, 593 bp, Homo sapiens
  Payload ID: 13555
  Gene Symbol: POT1
  Gene Name: protection of telomeres 1
  ENST ID: ENST00000609702
  CDS Start-End: 373-593
ctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataa

SEQ ID NO: 170442 - DNA, 549 bp, Homo sapiens
  Payload ID: 13555
  Gene Symbol: POT1
  Gene Name: protection of telomeres 1
  ENST ID: ENST00000608200
  CDS Start-End: 1-261
cttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggtaagatatttaagtcactgttttgttagaatactccttttgcatatttttcctaattaattattgtttaatacattttacagacaacctagtacatataaagtaaaaatagtatttaaatttaacaaaattgaatatatatgttaactaggttcaaatatatataagcacacgttcataaatttatcttaattacatttgaaattgtacttcagactcaagtgttaacatttaactatattgttggattgcattttattttgtcaatgctaagctgattgtctagttaagtaataataaaagaggctgattgctta

SEQ ID NO: 170443 - DNA, 1393 bp, Homo sapiens
  Payload ID: 13556
  Gene Symbol: PRMT1
  Gene Name: protein arginine methyltransferase 1
  Uniprot ID: Q99873
  ENST ID: ENST00000391851
  CDS Start-End: 130-1191
attgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 170444 - DNA, 1327 bp, Homo sapiens
  Payload ID: 13556
  Gene Symbol: PRMT1
  Gene Name: protein arginine methyltransferase 1
  ENST ID: ENST00000454376
  CDS Start-End: 10-1125
cgggtgaagatggcggcagccgaggccgcgaactgcatcatggagaattttgtagccaccttggctaatgggatgagcctccagccgcctcttgaagaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 170445 - DNA, 779 bp, Homo sapiens
  Payload ID: 13556
  Gene Symbol: PRMT1
  Gene Name: protein arginine methyltransferase 1
  ENST ID: ENST00000534465
  CDS Start-End: 159-779
agagttggcaaacccctgacctatgatggacgtattctctagccaattactagacggtattctcagacgggccgcctccattgccaatgaaatcttccagcggggtcgcggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaag

SEQ ID NO: 170446 - DNA, 766 bp, Homo sapiens
  Payload ID: 13556
  Gene Symbol: PRMT1
  Gene Name: protein arginine methyltransferase 1
  ENST ID: ENST00000534280
  CDS Start-End: 109-273
cggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggagaattttgtagccaccttggctaatgggatgagcctccagccgcctcttgaagaagtaaccccctttgcccttccctgtgtctgcccccattttccttcccctcccctccccagctgtgggctgagctagagacggggtcagagagactggagagatggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctg

SEQ ID NO: 170447 - DNA, 1182 bp, Homo sapiens
  Payload ID: 13556
  Gene Symbol: PRMT1
  Gene Name: protein arginine methyltransferase 1
  ENST ID: ENST00000529284
  CDS Start-End: 703-1182
agtgcagtggcgcgatctcagctcactgcaagctccgcctcccgggttcacgccatcctcctgcctaagcctccacgcccggctaattttttgtatttttagtagagacgggggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccgg

SEQ ID NO: 170448 - DNA, 699 bp, Homo sapiens
  Payload ID: 13556
  Gene Symbol: PRMT1
  Gene Name: protein arginine methyltransferase 1
  ENST ID: ENST00000527382
  CDS Start-End: 84-699
caaagagcgagctcattccgggattggagagaagtgtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctca

SEQ ID NO: 170449 - DNA, 578 bp, Homo sapiens
  Payload ID: 13556
  Gene Symbol: PRMT1
  Gene Name: protein arginine methyltransferase 1
  ENST ID: ENST00000526224
  CDS Start-End: 97-578
gagctttaccctactggagccgtttatctcccccgggtctttgtgagggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggca

SEQ ID NO: 170450 - DNA, 713 bp, Homo sapiens
  Payload ID: 13556
  Gene Symbol: PRMT1
  Gene Name: protein arginine methyltransferase 1
  ENST ID: ENST00000524771
  CDS Start-End: 1-713
aggccgcgaactgcatcatggaggtgagcgcttggagcgccgccgtgggcgggaggcggctttggaattttgtagccaccttggctaatgggatgagcctccagccgcctcttgaagaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaa

SEQ ID NO: 170451 - DNA, 1686 bp, Homo sapiens
  Payload ID: 13556
  Gene Symbol: PRMT1
  Gene Name: protein arginine methyltransferase 1
  ENST ID: ENST00000532489
  CDS Start-End: 507-1484
gggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgaactttttctgcaaatcaaggaaagcttcccggaggaagtggtgcctaagctgtgctctgattcacgtttagaagctgaccagacaaagagaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 170452 - DNA, 543 bp, Homo sapiens
  Payload ID: 13556
  Gene Symbol: PRMT1
  Gene Name: protein arginine methyltransferase 1
  ENST ID: ENST00000528623
  CDS Start-End: 354-543
ttccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagagaattttgtagccaccttggctaatgggatgagcctccagccgcctcttgaagaagtaaccccctttgcccttccctgtgtctgcccccattttccttcccctcccctccccagctgtgggctgagctagagacggggtcagagagactggagagatggtaggcgtggctgaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttca

SEQ ID NO: 170453 - DNA, 580 bp, Homo sapiens
  Payload ID: 13556
  Gene Symbol: PRMT1
  Gene Name: protein arginine methyltransferase 1
  ENST ID: ENST00000529836
  CDS Start-End: 251-580
cttcggcatccggcctagcggagggtcttatcccccctcccacgtggaggagggctgggggcgcttccggccaggcccccacgtggccgctgcgcgaattttgtagccaccttggctaatgggatgagcctccagccgcctcttgaagaagtaaccccctttgcccttccctgtgtctgcccccattttccttcccctcccctccccagctgtgggctgagctagagacggggtcagagagactggagagatggtaggcgtggctgaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaag

SEQ ID NO: 170454 - DNA, 1192 bp, Homo sapiens
  Payload ID: 13556
  Gene Symbol: PRMT1
  Gene Name: protein arginine methyltransferase 1
  ENST ID: ENST00000610806
  CDS Start-End: 130-987
attgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtc

SEQ ID NO: 170455 - DNA, 1702 bp, Homo sapiens
  Payload ID: 13557
  Gene Symbol: PRMT2
  Gene Name: protein arginine methyltransferase 2
  Uniprot ID: P55345
  ENST ID: ENST00000291705
  CDS Start-End: 226-912
actgcgcctgcgcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattg

SEQ ID NO: 170456 - DNA, 1334 bp, Homo sapiens
  Payload ID: 13557
  Gene Symbol: PRMT2
  Gene Name: protein arginine methyltransferase 2
  Uniprot ID: P55345
  ENST ID: ENST00000334494
  CDS Start-End: 168-1022
tgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggctgcgcctctcctgagctgccgcattctcccctgcacctgtgcgtctggccctcttcacgtcctcctggcctgctgtctgcctctcccctgcacctgtgcgtctgtccctcttcatgtcctccttgcctgctgtctgcctgttctcagagcccctcagccctcaggccttcatctctcctggcccatcttcctactctgacgctgacatgtagtaaaagtctgaagacagagaagagtgcatgtgcgtttagcataggaggggcagctttcagtcagtgcagcaagggcatgtagttgttcagagatggtgctggaacgactgatttggagaaaagaggcccttcttcacaccatctgctaaaataaacctcagatgggctcaagagttaaatatttaagaaaaggaggaaacaaaaaaattgctacaagtttatttgttgttaggatgggaaaggtttttctaagaaccaagttcataatgaagctgtcaaataaaatacttgacaaaaaa

SEQ ID NO: 170457 - DNA, 2688 bp, Homo sapiens
  Payload ID: 13557
  Gene Symbol: PRMT2
  Gene Name: protein arginine methyltransferase 2
  Uniprot ID: P55345
  ENST ID: ENST00000355680
  CDS Start-End: 763-2064
acttatccagaagaaaggcagagggcgcacactgcgcagcgcggatgggaaagttaactgaattatttgcgggaagacagaggaggtggggggtcccccaagccccagccattttgtggctcgtaggggttgtcgcttcccaagccgtgaatggcccaaacccgccccccgccccaggtcggactcctgccccgcgcccctctgggtcggaccccaagccgagccccccaaccccgcggctgggctgggcgattggggacgagctccacacatggagaacctggcctcgcctcgcaagaccgcgggacgcgcagatgtgaagtgcgcctgcgcggggcgcagccccagctgcagacgatctgtgagcgacgcgccggcgcaagtcgagggcggtggcttggcttccctggaatgggggacgtcttaggactgcgcctgcgcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtca

SEQ ID NO: 170458 - DNA, 954 bp, Homo sapiens
  Payload ID: 13557
  Gene Symbol: PRMT2
  Gene Name: protein arginine methyltransferase 2
  ENST ID: ENST00000397628
  CDS Start-End: 147-908
gagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggtgagggcgggcgtgcgggcagctgggggccggagctggggggcttctgagcacgggctcggctgggccaacctcaggatctcaagggtcgtgcgtgattcattttgatgttttccctaatgtgaggtctaattaatttcttgtgtggacattg

SEQ ID NO: 170459 - DNA, 2880 bp, Homo sapiens
  Payload ID: 13557
  Gene Symbol: PRMT2
  Gene Name: protein arginine methyltransferase 2
  Uniprot ID: P55345
  ENST ID: ENST00000397637
  CDS Start-End: 955-2256
gcgtgcactgcgcttgcgcgggttgagggcggtggctcaggctcctggaaaggaccgtccacccctccgcgctggcggtgtggacgcggaactcagcggagaaacgcgattgaggtaggtgtcctgatgggcagctcagatggctggactgcacgtaaggaaggacaggccaggtgaggcgtcctcgcactgcgtgtgcgtcgctggcggacagaggcctccgcccccttttgggacctccgagcgccttcgcgatctcagccactttccctggcgtccaaacgggagctcggtccccgtcacacccttccctgcgtgccgcaccccttcccggccactcccgccgtccagcgccttctacggccacgcccaccccaccaccatctctgtcacgcccttcgcggccacgcccacctgcctggcggcccctgccccgaagctcgcggcgctgtcccagcctgaccctctcgtgcccctgcgtccacgcgtggccctctcgcttcctgcccccttctcaccccccttcactggccacctgttccaaccctccatgatcctgttcctcccgagggcatcttaggagggcagggtcctgcgcgcactgcggcctccactccgaccccgtcccagtttggacccaggtcttccaatgaaaatataattatgcaaatcagtaagcatttgtaactacgaatatcacaaaaataagcttcaagtctggatttagaagtgaagcatgcattttaaacaaagaattgctatgcaattttaaaaacacattgatcccagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtca

SEQ ID NO: 170460 - DNA, 2131 bp, Homo sapiens
  Payload ID: 13557
  Gene Symbol: PRMT2
  Gene Name: protein arginine methyltransferase 2
  Uniprot ID: P55345
  ENST ID: ENST00000397638
  CDS Start-End: 206-1507
cgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtca

SEQ ID NO: 170461 - DNA, 1932 bp, Homo sapiens
  Payload ID: 13557
  Gene Symbol: PRMT2
  Gene Name: protein arginine methyltransferase 2
  Uniprot ID: P55345
  ENST ID: ENST00000440086
  CDS Start-End: 140-1135
gtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattgaaatata

SEQ ID NO: 170462 - DNA, 581 bp, Homo sapiens
  Payload ID: 13557
  Gene Symbol: PRMT2
  Gene Name: protein arginine methyltransferase 2
  ENST ID: ENST00000455177
  CDS Start-End: 1-581
gacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgttgttacaggatcttgcttgttctcctgaggccacgccacgatttccgagaagcaggttgcacactcagcagtctcccactagccagtggcactgcaggtgcaggggc

SEQ ID NO: 170463 - DNA, 1874 bp, Homo sapiens
  Payload ID: 13557
  Gene Symbol: PRMT2
  Gene Name: protein arginine methyltransferase 2
  Uniprot ID: P55345
  ENST ID: ENST00000458387
  CDS Start-End: 226-1131
actgcgcctgcgcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgcaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattg

SEQ ID NO: 170464 - DNA, 1878 bp, Homo sapiens
  Payload ID: 13557
  Gene Symbol: PRMT2
  Gene Name: protein arginine methyltransferase 2
  Uniprot ID: P55345
  ENST ID: ENST00000451211
  CDS Start-End: 226-1095
actgcgcctgcgcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattg

SEQ ID NO: 170465 - DNA, 1301 bp, Homo sapiens
  Payload ID: 13557
  Gene Symbol: PRMT2
  Gene Name: protein arginine methyltransferase 2
  ENST ID: ENST00000621201
  CDS Start-End: 305-790
gggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgcggataaagtcatcctggacgtgggctgtgggactgggatcatcagtctcttctgtgcacactatgcgcggcctagagcgggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggagacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattag

SEQ ID NO: 170466 - DNA, 2530 bp, Homo sapiens
  Payload ID: 13558
  Gene Symbol: PRMT3
  Gene Name: protein arginine methyltransferase 3
  ENST ID: ENST00000330796
  CDS Start-End: 190-330
gaagcgattgcgagccagcgcgcgcgcttcggcgttcccggcggtctgcgaagtttccggagcccgggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatcaacttataaaatattttaaaaata

SEQ ID NO: 170467 - DNA, 2653 bp, Homo sapiens
  Payload ID: 13558
  Gene Symbol: PRMT3
  Gene Name: protein arginine methyltransferase 3
  Uniprot ID: O60678
  ENST ID: ENST00000331079
  CDS Start-End: 218-1813
acgtgacccgcacggcgcctcgaggccggaagcgattgcgagccagcgcgcgcgcttcggcgttcccggcggtctgcgaagtttccggagcccgggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaa

SEQ ID NO: 170468 - DNA, 1736 bp, Homo sapiens
  Payload ID: 13558
  Gene Symbol: PRMT3
  Gene Name: protein arginine methyltransferase 3
  ENST ID: ENST00000437750
  CDS Start-End: 32-1441
agacacgccgggctctcggggcaccacagccatgtgctcgttagcgtcaggcgctaccggttattcacatctgctgaagaaacattttcacactgtaagtctgagcatcagtttaatattgacagcatggttcataaacatgaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattgg

SEQ ID NO: 170469 - DNA, 532 bp, Homo sapiens
  Payload ID: 13558
  Gene Symbol: PRMT3
  Gene Name: protein arginine methyltransferase 3
  ENST ID: ENST00000526583
  CDS Start-End: 1-165
atgtgctcgttagcgtcaggcgctaccggtgggtaccctggcccctcagcacccggctcgtccagccccaggccgcgccgctgtggggccggtggaagaccctccgggacacgggcccgggcagggtggggggctcgcagggatcatgaaggaggtgctgagtgagggccgcgggcgaacggggcggaggagagcccatcgtcacctgctcctcgagcccccgggccgcaccggtgtccgaggccgatctgattgttgtgtgtgtgtgttaggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttatt

SEQ ID NO: 170470 - DNA, 681 bp, Homo sapiens
  Payload ID: 13558
  Gene Symbol: PRMT3
  Gene Name: protein arginine methyltransferase 3
  ENST ID: ENST00000525188
  CDS Start-End: 108-248
cgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgcagaaagcaaaacagaaactggccaaacagtttgaagaattttgaaatcaaaatacaaaatgagatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatg

SEQ ID NO: 170471 - DNA, 2271 bp, Homo sapiens
  Payload ID: 13559
  Gene Symbol: PRMT5
  Gene Name: protein arginine methyltransferase 5
  Uniprot ID: O14744
  ENST ID: ENST00000216350
  CDS Start-End: 167-1897
aatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgc

SEQ ID NO: 170472 - DNA, 2531 bp, Homo sapiens
  Payload ID: 13559
  Gene Symbol: PRMT5
  Gene Name: protein arginine methyltransferase 5
  Uniprot ID: O14744
  ENST ID: ENST00000324366
  CDS Start-End: 225-2138
aagttcgtcaggaaccagaccctgagattggtggatccatgccgtacgccactgtgcagcccgcggattggcaggaaaagccactccccatccctcctgttcgggagctgtggcagacgctctggttgttaaggcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaccatgctgccccctg

SEQ ID NO: 170473 - DNA, 1907 bp, Homo sapiens
  Payload ID: 13559
  Gene Symbol: PRMT5
  Gene Name: protein arginine methyltransferase 5
  Uniprot ID: O14744
  ENST ID: ENST00000397440
  CDS Start-End: 132-1532
ggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcgttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 170474 - DNA, 2418 bp, Homo sapiens
  Payload ID: 13559
  Gene Symbol: PRMT5
  Gene Name: protein arginine methyltransferase 5
  Uniprot ID: O14744
  ENST ID: ENST00000397441
  CDS Start-End: 177-2039
agtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgac

SEQ ID NO: 170475 - DNA, 617 bp, Homo sapiens
  Payload ID: 13559
  Gene Symbol: PRMT5
  Gene Name: protein arginine methyltransferase 5
  ENST ID: ENST00000454731
  CDS Start-End: 1-538
agatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctat

SEQ ID NO: 170476 - DNA, 565 bp, Homo sapiens
  Payload ID: 13559
  Gene Symbol: PRMT5
  Gene Name: protein arginine methyltransferase 5
  ENST ID: ENST00000421938
  CDS Start-End: 8-565
gagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggtatttgtctttcttgggtgggggagtgcagactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacaca

SEQ ID NO: 170477 - DNA, 584 bp, Homo sapiens
  Payload ID: 13559
  Gene Symbol: PRMT5
  Gene Name: protein arginine methyltransferase 5
  ENST ID: ENST00000557415
  CDS Start-End: 32-292
gaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggag

SEQ ID NO: 170478 - DNA, 580 bp, Homo sapiens
  Payload ID: 13559
  Gene Symbol: PRMT5
  Gene Name: protein arginine methyltransferase 5
  ENST ID: ENST00000553550
  CDS Start-End: 32-580
gaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcgttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtac

SEQ ID NO: 170479 - DNA, 571 bp, Homo sapiens
  Payload ID: 13559
  Gene Symbol: PRMT5
  Gene Name: protein arginine methyltransferase 5
  ENST ID: ENST00000556616
  CDS Start-End: 16-571
agcgcgaggagaaagatggcggcgatggcggtcgggggtgctggtgggagccgcgtgtccagcgggagggacctgaattgcgtccccgaaatagctgacacactaggggctgtggccaagcagggtgcagactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttgggg

SEQ ID NO: 170480 - DNA, 414 bp, Homo sapiens
  Payload ID: 13559
  Gene Symbol: PRMT5
  Gene Name: protein arginine methyltransferase 5
  ENST ID: ENST00000553502
  CDS Start-End: 1-414
tcacagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgctagagaactggcagtttgaa

SEQ ID NO: 170481 - DNA, 1931 bp, Homo sapiens
  Payload ID: 13559
  Gene Symbol: PRMT5
  Gene Name: protein arginine methyltransferase 5
  ENST ID: ENST00000553915
  CDS Start-End: 141-350
aaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctg

SEQ ID NO: 170482 - DNA, 771 bp, Homo sapiens
  Payload ID: 13559
  Gene Symbol: PRMT5
  Gene Name: protein arginine methyltransferase 5
  ENST ID: ENST00000555454
  CDS Start-End: 1-534
gagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattcccc

SEQ ID NO: 170483 - DNA, 579 bp, Homo sapiens
  Payload ID: 13559
  Gene Symbol: PRMT5
  Gene Name: protein arginine methyltransferase 5
  ENST ID: ENST00000553787
  CDS Start-End: 13-141
gcgaggagaaagatggcggcgatggcggtcgggggtgctggtgggagccgcgtgtccagcgggagggacctgaattgcgtccccgaaatagctgacacactaggggctgtggccaagcagggctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactc

SEQ ID NO: 170484 - DNA, 555 bp, Homo sapiens
  Payload ID: 13559
  Gene Symbol: PRMT5
  Gene Name: protein arginine methyltransferase 5
  ENST ID: ENST00000554867
  CDS Start-End: 16-555
agcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagccc

SEQ ID NO: 170485 - DNA, 837 bp, Homo sapiens
  Payload ID: 13559
  Gene Symbol: PRMT5
  Gene Name: protein arginine methyltransferase 5
  ENST ID: ENST00000555530
  CDS Start-End: 1-837
cgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatactcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccgg

SEQ ID NO: 170486 - DNA, 577 bp, Homo sapiens
  Payload ID: 13559
  Gene Symbol: PRMT5
  Gene Name: protein arginine methyltransferase 5
  ENST ID: ENST00000554910
  CDS Start-End: 69-577
aacttgtgggaggcctgtggtcactgagtcccaaagttgggagagttgttgggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacct

SEQ ID NO: 170487 - DNA, 337 bp, Homo sapiens
  Payload ID: 13559
  Gene Symbol: PRMT5
  Gene Name: protein arginine methyltransferase 5
  ENST ID: ENST00000557443
  CDS Start-End: 1-185
gtatccgtccagagactcactctcctgggatgttctcatggtttcccatcctcttccctattaagcagcccataacggtacgtgaaggccaaaccatctgtgtgcgtttctggcgatgcagcaattccaagaagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgca

SEQ ID NO: 170488 - DNA, 603 bp, Homo sapiens
  Payload ID: 13559
  Gene Symbol: PRMT5
  Gene Name: protein arginine methyltransferase 5
  ENST ID: ENST00000556043
  CDS Start-End: 292-603
gaataagaatcaggaatttcatatatagtatacaattttgctacttcccctctgtctcagactggctttctcttaaagaagtaaacagattttgcgcaaaggagcaaggaagggtttcttgcctggcagtggttgacagtttttcttttgcctcatgtagctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagag

SEQ ID NO: 170489 - DNA, 1857 bp, Homo sapiens
  Payload ID: 13559
  Gene Symbol: PRMT5
  Gene Name: protein arginine methyltransferase 5
  Uniprot ID: O14744
  ENST ID: ENST00000553897
  CDS Start-End: 48-1829
ggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttg

SEQ ID NO: 170490 - DNA, 129 bp, Homo sapiens
  Payload ID: 13559
  Gene Symbol: PRMT5
  Gene Name: protein arginine methyltransferase 5
  ENST ID: ENST00000627278
  CDS Start-End: 1-129
atggcggcgatggcggtcgggggtgctggtgggagccgcgtgtccagcgggagggacctgaattgcgtccccgaaatagctgacacactaggggctgtggccaagcagggctttcctgctgccccttaa

SEQ ID NO: 170491 - DNA, 2616 bp, Homo sapiens
  Payload ID: 13560
  Gene Symbol: PRMT6
  Gene Name: protein arginine methyltransferase 6
  Uniprot ID: Q96LA8
  ENST ID: ENST00000370078
  CDS Start-End: 38-1165
gcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgccttttcacccggccactcactggaaacaggcgctcctctacctgaacgagccggtgcaagtggagcaagacacggacgtttcaggagagatcacgctgctgccctcccgggacaacccccgtcgcctgcgcgtgctgctgcgctacaaagtgggagaccaggaggagaagaccaaagactttgccatggaggactgagcgttgccttttctcccagctacctcccaaagcagcctgacctgcgtgggagaggcgtagcgaggtcggaggggaaagggagatcccacgtgcaagtagggggaatatctcccccttttccctcatagcctctagggagggagagtgacttcattctccatttgaagagattcttctggtgatgtttacttaaaaagtgatccccctcaacaacggatacagcgtgcttattattgggcatttagcctcaaaagcatgtagtaccaagcacttgtatttccgtatattttgtttcgcgggggagtgagggggaagaacacggatgaaaatgtcagtttttgaagggtccatgcacatccctgacacctcacaccttatctaagtctgaagctggggagaaaggggttcatttagacttcatacatttccagtacgactttagtatctctccagagccatattttctcagtccgaattaattccccctccctaggtgcctgtaggctatggtacttcttcctcattgttttctaggtaaacttcactactggtaattaaggggaaggatatgaggaagcagtttaaatagccctgttctcattactctgaccacatacatcatagggtgctaaagttgatgaacacattaatccgttaagtaaaatggactttgtaattgtacagcatacctaagaaactcagaaggtgcatttaagagagagacctgaaagaaatagtatggatttttaaaaattcttgtctctactattataaccaaaaaatatttcttgtatgtcccataaaaatatttgtgtaattcttatgaaacaggctggtagaggaggtttctgagcctagcccaagggcttattcatcaccatgggtaaattatttaaactcacttaattaaggaaaatattttcccagctagaaaagtatactcattctcatttaaactctctcatttggagggatcatgtgagttggcctacttacaagtagtgaaagttcccttttcagttttgttttgttttgttttgtttttctctttcactcagccaaatgtgaaagttgtgaatttaggaaaatcacttgtaatgaagtgtgaatcttgttatcaaatttatttctctgatgtttccttccttatccttgtagccaataaaacattgacattctcacgttttatagatgaggtaaaaagtcttgtgtgctgtgagttataatgcttttgcctttttaatattattagttcttaagtgttacagccccttcagaatataacttcaggacaattcaaactatgcttaatgtatgattttcgagcttctgtatgctaagaaaataggtgtgaaaaactggtgttctgaaatagcctaacatttattgtaattctgaattttctgcccttttattcattgcatattaaagtattagagtataaaaactaa

SEQ ID NO: 170492 - DNA, 4238 bp, Homo sapiens
  Payload ID: 13561
  Gene Symbol: PRMT7
  Gene Name: protein arginine methyltransferase 7
  Uniprot ID: Q9NVM4
  ENST ID: ENST00000339507
  CDS Start-End: 831-2909
ctttggggttctgtgtgcagcgagcatggtgtccttggcaccagggtttcggcagaggagcctagcgtgggcctacttggactcctccgcgtggggcagctcgggacacccgggcctgcaggagagcggggttctaggctggccccggctctgcagtgcagccgggtgcctgccactcgcggggctctgtcgcagtactcgtgcctggcgcctcccctcagccacagagaccgcagtagctccaaccatcgcacccctaactgggccacgagttctctgattgccagacctgttgtctttgccactcactgttctgagtaattggagagtcgtgtattcactacacgccaaccagagtggtcctgtaaaagcgtaagcctagtgtagatacgcttctgcttaaaactcttgagtggctcccagtgcttttagaacaaaatccaaacgcctttccgaagtcgacaaggcccagcttgattgagcagaagatgtgataggagatgaggagcggggggcttctgcaaaagtgcttcggtcgctcaggcttttggcacattttgcttatgcaacctagttctttctaccttagggccttttcttgggaaagttgggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggggttctgagtggctcatggctttctagcggggaaggctgaaggccctcctctcctctctgggagctgctcggcctcagggatgggaaagactgcgccgtgttgcatcttgttgcatctttgcactgctggcctctggctccagctgtggcaggaagcatgagagggtgactgaatttggagccctggaggggctgggaagacccccctgcttgtgcttctgaggtgctgagaatgctccaacacagagacatctctccccagctgggaagggagtggaagcacagggagcttgtggggctggccggtggggttgtccacgccgcccttggcgagcagtccccgtggcgggagcctgtcctgtctgtctcactctcgaggatctccgggtccctgctcttctggcttctgctaggagggtggagatgctgagttgtggctgggtctctggggcttgaagaccctggctgggcccgggctgagaggcctgggttctggccctttcacctgacaggtaacttcaagccacatccataggtgtctggcctcagtgctgcaccagctggtggcctgccaggacctgagactggacacaaggcagctgtcccagagcagttcctgagatgcaggcccaggaaagtggctgtcaggggagctgggaggcagccctgttccctgcacctccctcagattggaaagcccctcctgcaggtggggtatggcagggagcagcccctgcccagcgccgcttcaccaggaaggtcagtaggtgccgtggccttgcttctctcacacactaacccccctttggttatgtcccagctctcagaggtaacagcagacaccacgtgagagaacccagtggcctctggctcgcagcttagaaggtgaggcttgtgccaggccagccgagccgcctgtatgagcagagttccggtgtcctcggattcagggcagacttgggcagtgcctgtcctgcagttgggggcaggaactccctcccctgcccccaggcgtgcccctgaggcctggccccagcttgtcgctgaaataagtggagaacaccagccttgagcctcacagttttattttctcctcgttatccatccttcctttcagcaccagtaaggaaaaagaacacctctcttcgcaaaatattttatcaggtgtaaagacttgtttttcttctagggaagaaccgtctggatatatatttgataatgtttttaccaaaaccataggtgtgcttaccatagaaaacccctaatgtcccatgaagatacaatacagaaaaaaa

SEQ ID NO: 170493 - DNA, 2204 bp, Homo sapiens
  Payload ID: 13561
  Gene Symbol: PRMT7
  Gene Name: protein arginine methyltransferase 7
  Uniprot ID: Q9NVM4
  ENST ID: ENST00000441236
  CDS Start-End: 85-2163
gatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggggttctg

SEQ ID NO: 170494 - DNA, 2091 bp, Homo sapiens
  Payload ID: 13561
  Gene Symbol: PRMT7
  Gene Name: protein arginine methyltransferase 7
  Uniprot ID: Q9NVM4
  ENST ID: ENST00000449359
  CDS Start-End: 128-2056
aaaagtggtagcagcggaggcgagcggagggtttcccgcggcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagagttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggg

SEQ ID NO: 170495 - DNA, 2996 bp, Homo sapiens
  Payload ID: 13561
  Gene Symbol: PRMT7
  Gene Name: protein arginine methyltransferase 7
  ENST ID: ENST00000568975
  CDS Start-End: 786-2489
tttgaagtccactgcgtacccctccttgatcccatctctttcccttctcttttaggagttaactatcctgattccttgctatgctttttagtgtgatccctgaagaacgtatcactccattttgcatagctataaatttcatagaaatggaatcgtattgcatgtgttgtgtgatttgctgtttttgctcatcattatattcctgggattatccatttttaggtttatgtgtgactgtaatttattgtttagatgaaagttttcctggtttgacttgctctatcttcatatttttccttaagctaagggttcagcatacgaaggcagtattggtggcacttctttaacagtaccccatctcttctcctagccttgagggctgcacctagatgaacttgtgaggctcatttgaaccttttggaagcaccgaagcctgctgaagtttccagacatctgtatgaatctgttgtagttttttaatgttatatgctgaatataaaaccaagtaactcctgctggaaacatttacaatatcgattaacaaatactatcagtggctttgacatttttgtcagtttcttgatttttttccccgcttttgtctccccttcccccctccacattttggggcattgtgctgttaatagattttttttctgttcgtttgtttatatacctcctgtttccttctgatgttaatagatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggtgtgcagggaacagcaagatgtgcctcttgttcttgctgccacgcttccctgtgtcctggcgggcgggtgtggacggggctgctccttcctcacaggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggg

SEQ ID NO: 170496 - DNA, 584 bp, Homo sapiens
  Payload ID: 13561
  Gene Symbol: PRMT7
  Gene Name: protein arginine methyltransferase 7
  ENST ID: ENST00000566657
  CDS Start-End: 345-584
agctttccagttctgctttaggacccgccccccagcacgctcctcgacgctgcgaggtcccgccccgcgtgctggccgcggtaaaagtggtagcagcggaggcgagcggagggtttcccgcggcggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatg

SEQ ID NO: 170497 - DNA, 959 bp, Homo sapiens
  Payload ID: 13561
  Gene Symbol: PRMT7
  Gene Name: protein arginine methyltransferase 7
  ENST ID: ENST00000569571
  CDS Start-End: 291-959
gcgtgctggccgcggtaaaagtggtagcagcggaggcgagcggagggtttcccgcggcgggtgaggcgctgggtatgctgggaaggtggggtcgctttggggttctgtgtgcagcgagcatggtgtccttggcaccagggtttcggcagaggagcctagcgtgggcctacttggactcctccgcgtggggcagctcgggacacccggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccc

SEQ ID NO: 170498 - DNA, 562 bp, Homo sapiens
  Payload ID: 13561
  Gene Symbol: PRMT7
  Gene Name: protein arginine methyltransferase 7
  ENST ID: ENST00000566341
  CDS Start-End: 146-247
cgcggtaaaagtggtagcagcggaggcgagcggagggtttcccgcggcgggtgaggcgctggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaagaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcg

SEQ ID NO: 170499 - DNA, 440 bp, Homo sapiens
  Payload ID: 13561
  Gene Symbol: PRMT7
  Gene Name: protein arginine methyltransferase 7
  ENST ID: ENST00000565745
  CDS Start-End: 225-440
ctcgacgctgcgaggtcccgccccgcgtgctggccgcggtaaaagtggtagcagcggaggcgagcggagggtttcccgcggcggccttgagggctgcacctagatgaacttgtgaggctcatttgaaccttttggaagcaccgaagcctgctgaagtttccagacatctaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggc

SEQ ID NO: 170500 - DNA, 713 bp, Homo sapiens
  Payload ID: 13561
  Gene Symbol: PRMT7
  Gene Name: protein arginine methyltransferase 7
  ENST ID: ENST00000562381
  CDS Start-End: 210-534
agctttccagttctgctttaggacccgccccccagcacgctcctcgacgctgcgaggtcccgccccgcgtgctggccgcggtaaaagtggtagcagcggaggcgagcggagggtttcccgcggcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggag

SEQ ID NO: 170501 - DNA, 648 bp, Homo sapiens
  Payload ID: 13561
  Gene Symbol: PRMT7
  Gene Name: protein arginine methyltransferase 7
  ENST ID: ENST00000569047
  CDS Start-End: 140-648
aaaagtggtagcagcggaggcgagcggagggtttcccgcggcgggtgaggcgctggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaa

SEQ ID NO: 170502 - DNA, 1005 bp, Homo sapiens
  Payload ID: 13561
  Gene Symbol: PRMT7
  Gene Name: protein arginine methyltransferase 7
  ENST ID: ENST00000562050
  CDS Start-End: 116-217
agcggaggcgagcggagggtttcccgcggcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaagaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcag

SEQ ID NO: 170503 - DNA, 2366 bp, Homo sapiens
  Payload ID: 13562
  Gene Symbol: PRMT8
  Gene Name: protein arginine methyltransferase 8
  Uniprot ID: Q9NR22
  ENST ID: ENST00000382622
  CDS Start-End: 391-1575
agttggcggctgcctccggccggccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaa

SEQ ID NO: 170504 - DNA, 1204 bp, Homo sapiens
  Payload ID: 13562
  Gene Symbol: PRMT8
  Gene Name: protein arginine methyltransferase 8
  Uniprot ID: Q9NR22
  ENST ID: ENST00000452611
  CDS Start-End: 47-1204
atttctgcaccagggaggcttgctgtttgaatgtgtgccaggttgaatggagtctctggcttcagatggattcaagctgaaagaggtttcttctgtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttag

SEQ ID NO: 170505 - DNA, 3528 bp, Homo sapiens
  Payload ID: 13563
  Gene Symbol: PRMT9
  Gene Name: protein arginine methyltransferase 9
  Uniprot ID: Q6P2P2
  ENST ID: ENST00000322396
  CDS Start-End: 244-2781
agcgtgcgccgctggccaggtgcgcaatagtggggtatgcgtcacggtctgcgccgcccgcggggccaggacggggcggagcttccgcctgggctggggttggcgagttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaaggaaacttttcagtacacacttttcagatgggctgaagagcttgatgctctcagtcggatacaagacttacttggttgctatgagcaggccttggaactgtttcctgatgatgaagtgatttgcaatagtatgggggagcatctcttcagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaataaaagggtagcattattatagaaatactgctgcagatttgctttctggaaaaggatacatcactagttttttaaattaggaaacttcttttgctcgattttacagaatagggattttaaaagtcttatcgttattgacatgtgtaagtaaagcaaaactttacttttgtaggcatcttggccttttttcttaaatccaaacttgtaattgggaaacactgaaaggcttccactgaagactgagggttatggttacctgtaaattccaatcttgcttcctttaaatactcagtgtacatctgaaacatctcaggttttgttttgagaatgcaagcttgaaaaagaatttaagctataagctaaatgtaattaaaacagtaaaggagttagggaatacatcttcaggaggcagcatttttcttggtctactttggcaaaagaacatttaaaagctggtaacaaaacaaagttaaattgaaggaagacttaatcctatactatttttcaaagttttgatttggatgtacaataagtacattaattgatccaatttttacaaacttttgaaataaaggaagatcattattatgcctccta

SEQ ID NO: 170506 - DNA, 2674 bp, Homo sapiens
  Payload ID: 13563
  Gene Symbol: PRMT9
  Gene Name: protein arginine methyltransferase 9
  ENST ID: ENST00000514886
  CDS Start-End: 139-339
agttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattct

SEQ ID NO: 170507 - DNA, 4072 bp, Homo sapiens
  Payload ID: 13564
  Gene Symbol: PATL1
  Gene Name: protein associated with topoisomerase II homolog 1 (yeast)
  Uniprot ID: Q86TB9
  ENST ID: ENST00000300146
  CDS Start-End: 86-2398
acccgcgcgcggaggagccggggagtcagcgcttcttccctccctccccctctcccctccccgctccctgcccccctccccaagaatgttccgctacgagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 170508 - DNA, 1950 bp, Homo sapiens
  Payload ID: 13565
  Gene Symbol: PATL2
  Gene Name: protein associated with topoisomerase II homolog 2 (yeast)
  Uniprot ID: C9JE40
  ENST ID: ENST00000434130
  CDS Start-End: 99-1730
gaaaggacagcaacagtcaggtggtttaccttccagaggctggcaatgctgtttcactggaggacacggctaagaaggaagtccaccagcctgccaagatgaattgccttgaagggccaggtaagacctgtggccccttggcttctgaggaggagctggtgtctgcctgccagttggaaaaagaagaagagaatgaaggggaggaggaggaagaggaggaggacgaggaggatctggacccagatctggacccagacctagaggaggaagagaatgatcttggggatccagctgtacttggtgctgtccacaacacccagagagctctgcttagctcccctggagtcaaggcccctggtatgctgggaatgtcacttgcctccttgcattttctgtggcagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatgcggtaccccatggaactcaagagcaggatatagaagctgcaagcagtcagaggcttcgggtattataccggattgagaagatgttccttcagttactagaaatagaggaaggctggaagtataggcctccaccgccctgcttttctgagcagcaaagcaaccaggttgagaagctcttccagaccttaaagacccaggagcagaacaacctggaagaggcagcagatggcttcctgcaggtgctctctgtgaggaaggggaaggccctggtggcccggctgctccccttcctgccccaggatcaggctgttaccattcttttggctatcacccaccatctgcccctcctggtccggagggatgtggctgatcaggccctacaaatgttattcaaacctctgggcaaatgtattagtcacttgaccctccacgaactcctccaaggacttcagggattaacgctgttgccacctggctcctcagagcggccagtcaccgtggtgcttcagaatcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaatg

SEQ ID NO: 170509 - DNA, 1863 bp, Homo sapiens
  Payload ID: 13565
  Gene Symbol: PATL2
  Gene Name: protein associated with topoisomerase II homolog 2 (yeast)
  ENST ID: ENST00000560780
  CDS Start-End: 581-1645
gaaaggacagcaacagtcaggtggtttaccttccagaggctggcaatgctgtttcactggaggacacggctaagaaggaagtccaccagcctgccaagatgaattgccttgaaggagagggagagggatcctggcccagctgactttgaatctgagggagggccaagctgccactgccctggatgttggaacacctggtcttgctgcttcctcccaccacctcaaaaacacagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagagagccccacttcctgctcaccacactccttaggaagtgccagtggtgggtaagtctaaagggttgttcctcctggcttaaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatgcggtaccccatggaactcaagagcaggatatagaagctgcaagcagtcagaggcttcgggtattataccggattgagaagatgttccttcagttactagaaatagaggaaggctggaagtataggcctccaccgccctgcttttctgagcagcaaagcaaccaggttgagaagctcttccagaccttaaagacccaggagcagaacaacctggaagaggcagcagatggcttcctgcaggtgctctctgtgaggaaggggaaggccctggtggcccggctgctccccttcctgccccaggatcaggctgttaccattcttttggctatcacccaccatctgcccctcctggtccggagggatgtggctgatcaggccctacaaatgttattcaaacctctgggcaaatgtattagtcacttgaccctccacgaactcctccaaggacttcagggattaacgctgttgccacctggctcctcagagcggccagtcaccgtggtgcttcagaatcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaa

SEQ ID NO: 170510 - DNA, 531 bp, Homo sapiens
  Payload ID: 13565
  Gene Symbol: PATL2
  Gene Name: protein associated with topoisomerase II homolog 2 (yeast)
  ENST ID: ENST00000558809
  CDS Start-End: 1-477
caggccctacaaatgttattcaaacctctgggcaaatgtattagtcacttgaccctccacgaactcctccaaggacttcagggattaacgctgttgccacctggctcctcagagcggccagtcaccgtggtgcttcagaatcaggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaa

SEQ ID NO: 170511 - DNA, 765 bp, Homo sapiens
  Payload ID: 13565
  Gene Symbol: PATL2
  Gene Name: protein associated with topoisomerase II homolog 2 (yeast)
  ENST ID: ENST00000560110
  CDS Start-End: 390-765
ctggtgatgtcggttgggaagtacttctcttcctgcttctagcctgtgcctcatttctgtccctttgtgggacagctccctagagccgagctgggagggtgggtgtttatggcagtctgagaccccagggtctctctcctcaagaccatggccaagaattctctaaccatcttgctgggaggattccatggctgttttagggtgccatgtcatccttactgactgaggatggtgcctcttggcctctttcttgtctcaggtttaccttccagaggctggcaatgctgtttcactggaggacacggctaagaaggaagtccaccagcctgccaagatgaattgccttgaagagagctctgcttagctcccctggagtcaaggcccctggtatgctgggaatgtcacttgcctccttgcattttctgtggcagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagagagccccacttcctgctcaccacactccttaggaagtgccagtggtgggtaagtctaaagggttgttcctcctggcttaaagtcccccagccaagaagccttggtctcagcagccagaccc

SEQ ID NO: 170512 - DNA, 1913 bp, Homo sapiens
  Payload ID: 13565
  Gene Symbol: PATL2
  Gene Name: protein associated with topoisomerase II homolog 2 (yeast)
  Uniprot ID: C9JE40
  ENST ID: ENST00000560775
  CDS Start-End: 61-1692
gctggcaatgctgtttcactggaggacacggctaagaaggaagtccaccagcctgccaagatgaattgccttgaagggccaggtaagacctgtggccccttggcttctgaggaggagctggtgtctgcctgccagttggaaaaagaagaagagaatgaaggggaggaggaggaagaggaggaggacgaggaggatctggacccagatctggacccagacctagaggaggaagagaatgatcttggggatccagctgtacttggtgctgtccacaacacccagagagctctgcttagctcccctggagtcaaggcccctggtatgctgggaatgtcacttgcctccttgcattttctgtggcagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatgcggtaccccatggaactcaagagcaggatatagaagctgcaagcagtcagaggcttcgggtattataccggattgagaagatgttccttcagttactagaaatagaggaaggctggaagtataggcctccaccgccctgcttttctgagcagcaaagcaaccaggttgagaagctcttccagaccttaaagacccaggagcagaacaacctggaagaggcagcagatggcttcctgcaggtgctctctgtgaggaaggggaaggccctggtggcccggctgctccccttcctgccccaggatcaggctgttaccattcttttggctatcacccaccatctgcccctcctggtccggagggatgtggctgatcaggccctacaaatgttattcaaacctctgggcaaatgtattagtcacttgaccctccacgaactcctccaaggacttcagggattaacgctgttgccacctggctcctcagagcggccagtcaccgtggtgcttcagaatcagtttggaatatctttgctctatgccctgctgagccatggggagcaactggtatcgctgcattcttccctagaggaacccaacagtgaccatacagcttggacagacatggtggttctgattgcctgggagatagcccaaatgcctacagcctctctggcagaacccctagctttccccagcaacctacttcccctgttctgtcaccacgtggacaaacaattggttcagcagctggaggccaggatggagtttgcctggatttactgatctgtttgttctggaatacgtgtatgtgggaagttgaatcatcagacactagctacatagactatgtttacagggatccagagagtctgaagacatttcttatgcctttatatattggagaacccttccccattttcatatcctttcttcaaaaatctaaatgatgtgcctaaaaataagacatggcataataaggtataattaaagagataatagaatga

SEQ ID NO: 170513 - DNA, 845 bp, Homo sapiens
  Payload ID: 13565
  Gene Symbol: PATL2
  Gene Name: protein associated with topoisomerase II homolog 2 (yeast)
  ENST ID: ENST00000558481
  CDS Start-End: 1-566
aagagaatgaaggggaggaggaggaagaggaggaggacgaggaggatctggacccagatctggacccagacctagaggaggaagagaatgatcttggggatccagctgtacttggtgctgtccacaacacccagagagctctgcttagctcccctggagtcaaggcccctggtatgctgggaatgtcacttgcctccttgcattttctgtggcagaccttggactacctgtcgcccatccctttctggcctacatttcccagcaccagctctccagcacagcactttggacctcggctgccctcaccagacccaactctcttctgcagcctgctgacctcgtggccccctaggttcagtcatctgacccagctccaccctcggcaccaacgaatcttgcagcagcagcagcatagtcaaacaccaagagagccccacttcctgctcaccacactccttaggaagtgccagtggtgggtaagtctaaagggttgttcctcctggcttaaagtcccccagccaagaagccttggtctcagcagccagacccctatgctaacctcatgaccagaaaagagaaggactgggtgataaaagtgcagatggtgcagctgcagagtgcaaaaccccgcctggatgactactattaccaggaatattaccagaagctagagaagaagcaggcagacgaagagctacttggacgaagaaaccgggttgagtccctcaagctggtaacgccttacattccgaaggcagaggcttatgagtccgtggtccgaatcgagggttccctgggccaggtagctgtgtcgacatgcttcagccctcgccgagctattgatg

SEQ ID NO: 170514 - DNA, 1773 bp, Homo sapiens
  Payload ID: 13566
  Gene Symbol: PROC
  Gene Name: protein C (inactivator of coagulation factors Va and VIIIa)
  Uniprot ID: P04070
  ENST ID: ENST00000234071
  CDS Start-End: 88-1473
aactcgaactccaggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaagcca

SEQ ID NO: 170515 - DNA, 779 bp, Homo sapiens
  Payload ID: 13566
  Gene Symbol: PROC
  Gene Name: protein C (inactivator of coagulation factors Va and VIIIa)
  ENST ID: ENST00000402125
  CDS Start-End: 1-710
attgctcgctggacaacggcggctgcacgcattactgcctagaggaggtgggctggcggcgctgtagctgtgcgcctggctacaagctgggggacgacctcctgcagtgtcaccccgcaggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagca

SEQ ID NO: 170516 - DNA, 1586 bp, Homo sapiens
  Payload ID: 13566
  Gene Symbol: PROC
  Gene Name: protein C (inactivator of coagulation factors Va and VIIIa)
  ENST ID: ENST00000409048
  CDS Start-End: 62-1549
cgggggtaggcactgcccggagctcagaagtcctcctcagacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtggtcctgctggactcaaagaagaagctggcctgcggggcagtgctcatccacccctcctgggtgctgacagcggcccactgcatggatgagtccaagaagctccttgtcaggcttggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaat

SEQ ID NO: 170517 - DNA, 566 bp, Homo sapiens
  Payload ID: 13566
  Gene Symbol: PROC
  Gene Name: protein C (inactivator of coagulation factors Va and VIIIa)
  ENST ID: ENST00000431364
  CDS Start-End: 247-405
attctggagctgctttctaggcaggcagtgtgagctcagccccacgtagagcgggcagccgaggccttctgaggctatgtctctagcgaacaaggaccctcaatcccagcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttca

SEQ ID NO: 170518 - DNA, 500 bp, Homo sapiens
  Payload ID: 13566
  Gene Symbol: PROC
  Gene Name: protein C (inactivator of coagulation factors Va and VIIIa)
  ENST ID: ENST00000419985
  CDS Start-End: 84-242
aactcgaactccaggctgtcatggcggcaggacggcgaacttgcagtatctccacgacccgcccctgtgccagtgcctccagaatgtggcagctcacaagcctcctgctgttcgtggccacctggggaatttccggcacaccagctcctcttggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccggg

SEQ ID NO: 170519 - DNA, 598 bp, Homo sapiens
  Payload ID: 13566
  Gene Symbol: PROC
  Gene Name: protein C (inactivator of coagulation factors Va and VIIIa)
  ENST ID: ENST00000427769
  CDS Start-End: 251-598
ctgcattctggagctgctttctaggcaggcagtgtgagctcagccccacgtagagcgggcagccgaggccttctgaggctatgtctctagcgaacaaggaccctcaatcccagcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggc

SEQ ID NO: 170520 - DNA, 600 bp, Homo sapiens
  Payload ID: 13566
  Gene Symbol: PROC
  Gene Name: protein C (inactivator of coagulation factors Va and VIIIa)
  ENST ID: ENST00000442644
  CDS Start-End: 76-600
aggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcgaggaggtgggctggcggcgctgtagctgtgcgcctggctacaagctgggggacgacctcctgcagtgtcaccccgcagtgaagttcccttgtgggaggccctggaagcggatggagaagaagcgc

SEQ ID NO: 170521 - DNA, 581 bp, Homo sapiens
  Payload ID: 13566
  Gene Symbol: PROC
  Gene Name: protein C (inactivator of coagulation factors Va and VIIIa)
  ENST ID: ENST00000429925
  CDS Start-End: 203-581
actcgaactccaggctgtcatggcggcaggacggcgaacttgcagtatctccacgacccgcccctcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacactggccttctggtccaagcacgtcgacggtgaccagtgcttggtcttgcccttggagcacccgtgcgccagcctgtgctgcgggcacggcacgtgcatcgacggcatcggcagcttcagctgcgactgccgcagcggctggg

SEQ ID NO: 170522 - DNA, 1348 bp, Homo sapiens
  Payload ID: 13567
  Gene Symbol: PROCR
  Gene Name: protein C receptor, endothelial
  Uniprot ID: Q9UNN8
  ENST ID: ENST00000216968
  CDS Start-End: 83-799
cttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 170523 - DNA, 642 bp, Homo sapiens
  Payload ID: 13567
  Gene Symbol: PROCR
  Gene Name: protein C receptor, endothelial
  ENST ID: ENST00000635377
  CDS Start-End: 1-641
cctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagataatggagttggggcaggaagcctatggcccatcctccaaagacagacagaatcacctgaggcgttcaaaagatataaccaaataaacaagtcatccacaatcaaaatacaacattcaatacttccagatctctactaag

SEQ ID NO: 170524 - DNA, 442 bp, Homo sapiens
  Payload ID: 13567
  Gene Symbol: PROCR
  Gene Name: protein C receptor, endothelial
  ENST ID: ENST00000634509
  CDS Start-End: 1-105
gcctacaaccgcactcggtatgaactgcgggaattcctggaggacacctgtgtgcagtatgtgcagaaacatatttccgcggaaaacacgaaagatctctactaagaatgtcactctggccgggcgcagtggctcactcctgtaatcccagcactttgggaggccgaggcaggaggatcacttgaggttgggagttcgagaccagcatgaccaacatggaaaaaccccgtctctactaaaaatacaaaattagccaggcgtggtggtgcatgtctgtaatcccagctactcgggaggctgaggcaggagaatcacttgaacccgggaggcaggggttgcggtgagccgagatcacaccattgcactccagcctgggctacaagagcgaaactctgtctcaaataaataaataaataaaacaaaataaaaaataaagaatgtc

SEQ ID NO: 170525 - DNA, 1698 bp, Homo sapiens
  Payload ID: 13568
  Gene Symbol: PDIA2
  Gene Name: protein disulfide isomerase family A, member 2
  Uniprot ID: Q13087
  ENST ID: ENST00000219406
  CDS Start-End: 19-1596
acgcgccctggcagcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacctgcaggacgaggacgtggccaccttcttggccttggcccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccagacgtctgccaagatcttcgcggccaggatcctcaaccacctgctgctgtttgtcaaccagacgctggctgcgcaccgggagctcctagcgggctttggggaggcagctccccgcttccgggggcaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctgga

SEQ ID NO: 170526 - DNA, 1575 bp, Homo sapiens
  Payload ID: 13568
  Gene Symbol: PDIA2
  Gene Name: protein disulfide isomerase family A, member 2
  Uniprot ID: Q13087
  ENST ID: ENST00000404312
  CDS Start-End: 6-1574
gcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacgaggacgtggccaccttcttggccttggcccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggggatctgtcgcgcttcctggtcacacacagcatgcgcctggtcacggagttcaacagccagacgtctgccaagatcttcgcggccaggatcctcaaccacctgctgctgtttgtcaaccagacgctggctgcgcaccgggagctcctagcgggctttggggaggcagctccccgcttccgggggcaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaagccctatctcctgagccaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagc

SEQ ID NO: 170527 - DNA, 680 bp, Homo sapiens
  Payload ID: 13568
  Gene Symbol: PDIA2
  Gene Name: protein disulfide isomerase family A, member 2
  ENST ID: ENST00000456379
  CDS Start-End: 1-680
agcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggaccacgggacgctgagggcattgccgagtggctgcgacggcgggtggggcccagtgccatgcggctggaggacgaggcggccgcccaggcgctgatcggtggccgggacctagtggtcattggcttcttccaggacgccctggacatgacctttggcctcacagaccggccgcggctctttcagcagtttggcctcaccaaggacactgtggttctcttcaagaagtttgatgaggggcgggcagacttccccgtggacgaggagcttggcctggacctgggg

SEQ ID NO: 170528 - DNA, 567 bp, Homo sapiens
  Payload ID: 13568
  Gene Symbol: PDIA2
  Gene Name: protein disulfide isomerase family A, member 2
  ENST ID: ENST00000435833
  CDS Start-End: 1-465
gcagtcctcaacggccaagtcaaggagataccccctgattgggatcagcggccagttaagaccctcgtgggcaagaattttgagcaggtggcttttgacgaaaccaagaatgtgtttgtcaagttctatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtgattgaatacaaaagcaccagggacctggagactttctccaagttcctggacaacgggggcgtgctgcccacggaggagcccccggaggagccagcagccccgttcccggagccaccggccaactccactatggggtccaaggaggaactgtagctgcccccgtgtcacccccgccatcactgctggacaggagccacccccttgggtaccagagggagctgtgcattgtgaataaagagtgagcttggttctgga

SEQ ID NO: 170529 - DNA, 3727 bp, Homo sapiens
  Payload ID: 13569
  Gene Symbol: PDIA3
  Gene Name: protein disulfide isomerase family A, member 3
  Uniprot ID: P30101
  ENST ID: ENST00000300289
  CDS Start-End: 149-1666
gccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacacagaagcagtcagttttaattttttagccatgttggtaaaagttcattttcagtacatgggtaacacccaggccctttcccattatatccaggtatgctacaagttcttttaactcttatcagaagttattattactgtttccttagagaggctaccaggctaaaattcacttagtttggtttgtctaatgtcctcattattttatcctgaagatgatgtcatttctcaggacttgaaaatgacttggctgaactaaaggtaaaaaagccaagcctctgtcacttttcctagactcctaggcacagctatggagtctttgcacagtgcccataccctaaaaattaataatgaaaaccaaacctcaagaacctagagcagctctctacttgccaccatggactccagtggtcagcataagaaaagcagatagttgcattctatttagtttatagctgctttgttcctttgtgtttcactaagcagaggctcaaaaattcccttgataacttcagctgcccctgttcttttcctcaaactccaggatgagacctttaatgtgggacaatttctggtgaaggtactcacagcgacgcttttcttctctgtaacttgggtactgctgcagagaaaaagcatccatgtcaaaaagtaaaaattctcattctaccttgc

SEQ ID NO: 170530 - DNA, 725 bp, Homo sapiens
  Payload ID: 13569
  Gene Symbol: PDIA3
  Gene Name: protein disulfide isomerase family A, member 3
  ENST ID: ENST00000455250
  CDS Start-End: 1-372
tccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctggggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgat

SEQ ID NO: 170531 - DNA, 596 bp, Homo sapiens
  Payload ID: 13569
  Gene Symbol: PDIA3
  Gene Name: protein disulfide isomerase family A, member 3
  ENST ID: ENST00000446523
  CDS Start-End: 88-315
agcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggttacagaactcaccttctcaacgtgatccctctgcaaccctttggcttttgaaaaggtgatgtacagctggtgctagctgtatatacactgattaggattttctgggcagaggagccggtgcttctggtggccctctgggaaaggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctg

SEQ ID NO: 170532 - DNA, 2107 bp, Homo sapiens
  Payload ID: 13569
  Gene Symbol: PDIA3
  Gene Name: protein disulfide isomerase family A, member 3
  ENST ID: ENST00000434494
  CDS Start-End: 88-303
agcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctgttccattcctgctggatttgaagaggagagtctcctccagcctcattgaaactctttttgtggatttgatgaccttatggatattgccaaagtttaaggcagtggattttagtcccagccttgcagcttacacacacacctggttgctccccagatttctggagattctcattcagtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtc

SEQ ID NO: 170533 - DNA, 2903 bp, Homo sapiens
  Payload ID: 13570
  Gene Symbol: PDIA4
  Gene Name: protein disulfide isomerase family A, member 4
  Uniprot ID: P13667
  ENST ID: ENST00000286091
  CDS Start-End: 234-2171
ggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaa

SEQ ID NO: 170534 - DNA, 550 bp, Homo sapiens
  Payload ID: 13570
  Gene Symbol: PDIA4
  Gene Name: protein disulfide isomerase family A, member 4
  ENST ID: ENST00000413966
  CDS Start-End: 61-550
gagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattttcgtcaggtccaggctaactccaggcgaacgcgcccaggcagtgggaagggagagggagagccactggagagaaggggcgagggcgtgaagaaacaagtgcgagttctttggaacagcaagcattccttttcaaaatgtgattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattc

SEQ ID NO: 170535 - DNA, 1799 bp, Homo sapiens
  Payload ID: 13571
  Gene Symbol: PDIA5
  Gene Name: protein disulfide isomerase family A, member 5
  Uniprot ID: Q14554
  ENST ID: ENST00000316218
  CDS Start-End: 96-1655
gccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 170536 - DNA, 722 bp, Homo sapiens
  Payload ID: 13571
  Gene Symbol: PDIA5
  Gene Name: protein disulfide isomerase family A, member 5
  ENST ID: ENST00000469649
  CDS Start-End: 1-250
caccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaa

SEQ ID NO: 170537 - DNA, 1651 bp, Homo sapiens
  Payload ID: 13571
  Gene Symbol: PDIA5
  Gene Name: protein disulfide isomerase family A, member 5
  Uniprot ID: Q14554
  ENST ID: ENST00000489923
  CDS Start-End: 104-892
gggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaaggtgtggccactgtaagaaaatgaagccggagtttgagaaggcagcagaagccctccatggagaagcggatctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 170538 - DNA, 667 bp, Homo sapiens
  Payload ID: 13571
  Gene Symbol: PDIA5
  Gene Name: protein disulfide isomerase family A, member 5
  ENST ID: ENST00000484644
  CDS Start-End: 475-667
gggcactgggtgctacgcgggagacagcgggcgtcccggtgccctcgccgccaagcgctcccggacgcaggggcaggaggcagctgtggggcgccgggagatccctggcagggtgcttacgccacggccacaactttgcggggatgcaggtcggggcacagccggtcgggcaggacgccggcgggctgcggggtgagctccgctccagactccgagccctgcacctgtgtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaagg

SEQ ID NO: 170539 - DNA, 2338 bp, Homo sapiens
  Payload ID: 13572
  Gene Symbol: PDIA6
  Gene Name: protein disulfide isomerase family A, member 6
  Uniprot ID: Q15084
  ENST ID: ENST00000272227
  CDS Start-End: 149-1471
agcgccttccggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaa

SEQ ID NO: 170540 - DNA, 2534 bp, Homo sapiens
  Payload ID: 13572
  Gene Symbol: PDIA6
  Gene Name: protein disulfide isomerase family A, member 6
  Uniprot ID: Q15084
  ENST ID: ENST00000381611
  CDS Start-End: 332-1669
aaccgagggtgcccgctgcaaggttaggtctcctggcctcgtgcttcaaacaggaattaatagaatcccaccaggtggtgtttgtgaggcgtagatggcgaggatatctgcagctgcagtttgctcattctcacggctgcactgcattgcactgtgtgagcagaacacaatttatccttccactgctgatgggcatttgggcggtttgcagtttgggatctggccagttctgctgttgtgagcattcttaagcctgcctttcggtgaattcacacgcccgtggggctcaccaacttctcctgcccactccctatcaaggaaaagtcccataatgtatccatcaaccaccatggctaatgcacccggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcact

SEQ ID NO: 170541 - DNA, 2236 bp, Homo sapiens
  Payload ID: 13572
  Gene Symbol: PDIA6
  Gene Name: protein disulfide isomerase family A, member 6
  Uniprot ID: Q15084
  ENST ID: ENST00000404824
  CDS Start-End: 373-1839
agaacccctcagggcctcagctgaagctcagacagagtgcctgcgtgcgcgcgcacacacacacacacacacacacacaacctaattttcaacacacttgcacaaatatagaaacatcatggggaaaaatgcaaaatacctatgatttctggaacaagatccaagatgacaaagatattccctgcttattctgctcatgcccgggctcccctgcccacccccagtgcgttcatgtgatatcatgaaaaagcagcaggggtggcatgaacttgcacaccaggctgcccaggcttgagacccagctctgccacctagaagcttggagcccctgaacaagctgcaattctgtgcctgggcttttctgactgcaaaatgaggataatcacagcccctgcctccaaagtgtcccgaggatcaaatgagttgatgatacttgcacggcgctcggatcgtggctcaccaacttctcctgcccactccctatcaaggaaaagtcccataatgtatccatcaaccaccatggctaatgcacccggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgcc

SEQ ID NO: 170542 - DNA, 2682 bp, Homo sapiens
  Payload ID: 13572
  Gene Symbol: PDIA6
  Gene Name: protein disulfide isomerase family A, member 6
  Uniprot ID: Q15084
  ENST ID: ENST00000404371
  CDS Start-End: 339-1817
aaccgagggtgcccgctgcaaggttaggtctcctggcctcgtgcttcaaacaggaattaatagaatcccaccaggtggtgtttgtgaggcgtagatggcgaggatatctgcagctgcagtttgctcattctcacggctgcactgcattgcactgtgtgagcagaacacaatttatccttccactgctgatgggcatttgggcggtttgcagtttgggatctggccagttctgctgttgtgagcattcttaagcctgcctttcggtgaattcacacgcccgtggggacgctcactctcagagcacagcttccagaggagagaagatacccccagcatccatgagaagagacctccgggagaagcttgtgtgggtgtgccgaccactggccccagttgaggtcccagccaacatcagctccgacttccagccatgctcaccaacttctcctgcccactccctatcaaggaaaagtcccataatgtatccatcaaccaccatggctaatgcacccggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcact

SEQ ID NO: 170543 - DNA, 986 bp, Homo sapiens
  Payload ID: 13572
  Gene Symbol: PDIA6
  Gene Name: protein disulfide isomerase family A, member 6
  ENST ID: ENST00000458536
  CDS Start-End: 953-986
attgcactgtgtgagcagaacacaatttatccttccactgctgatgggcatttgggcggtttgcagtttgggatctggccagttctgctgttgtgagcattcttaagcctgcctttcggtgaattcacacgcccgtgggaagttcatatgagccataacaaggattggaagaagttttagaagtaacctcctgggagtccatgaattagcagcagtgagaggctagaggcctgacaaagaattgagaagcagctgctatatcccaagtggcaaatgccagtgtggatggagaagagagagcttcattctgtggcaggaaagcttggctgctgacaatgagactgcacccttgggatttgtcccttggattctttagcatctgagctctaacctctgaaacacaagaaaaaatgagcaagatgtttgctcagcatcaattcagataccgctgaatagaaggcaacacccaaccacacagccagaggcctcctgggtaaatcggggactgctctcctctgacccctctttctcctgcctctaccccttggcttcacagcaattattcattttttaacactcaaatgctgggtacctgttgcctatgtcggggcacgctgttactccctacacacaggtaaaattgattaaccgaatcttgccctccactggcttactgtgcaacggtagagactggaagcaacagacgagggtgagctttggaagagctgatgaggccatgattaatttcaactgagaggacgctcactctcagagcacagcttccagaggagagaagatacccccagcatccatgagaagagacctccgggagaagcttgtgtgggtgtgccgaccactggccccagttgaggtcccagccaacatcagctccgacttccagccatgctcaccaacttctcctgcccactccctatcaaggaaaagtcccataatgtatccatcaaccaccatggctaatgcacccg

SEQ ID NO: 170544 - DNA, 2509 bp, Homo sapiens
  Payload ID: 13572
  Gene Symbol: PDIA6
  Gene Name: protein disulfide isomerase family A, member 6
  Uniprot ID: Q15084
  ENST ID: ENST00000540494
  CDS Start-End: 331-1644
cttccggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcgcctgcttgtaacagcatgaagaggagaggactgacgttattgctgtccttgattggcaaagagaagtgaaagtacctaattctgccacagtctacctaatgatgctctgtggattatacccctgcattctccagcccttcggttagaaatttgggtctatctaattatatgatcttaggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcact

SEQ ID NO: 170545 - DNA, 2344 bp, Homo sapiens
  Payload ID: 13572
  Gene Symbol: PDIA6
  Gene Name: protein disulfide isomerase family A, member 6
  Uniprot ID: Q15084
  ENST ID: ENST00000617249
  CDS Start-End: 1-1479
atgagaagagacctccgggagaagcttgtgtgggtgtgccgaccactggccccagttgaggtcccagccaacatcagctccgacttccagccatgctcaccaacttctcctgcccactccctatcaaggaaaagtcccataatgtatccatcaaccaccatggctaatgcacccggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcact

SEQ ID NO: 170546 - DNA, 2153 bp, Homo sapiens
  Payload ID: 13573
  Gene Symbol: PDILT
  Gene Name: protein disulfide isomerase-like, testis expressed
  Uniprot ID: Q8N807
  ENST ID: ENST00000302451
  CDS Start-End: 250-2004
agaactttgctgctgaggctgctgtggcctctgtgtgcccaggaagggacttcatttctgcctgtggattctttagaatgcccagtcgtctgcgggtcctgccctgatcacaaggagaagccaggagcctcctcttcaggctacaaccttccttcttaagggccacagagtttgtggccccacccccagcacagccccaccttggccccaggaaccctgggagtggccttggcttcctgcaggacagccatggacctactctggatgcccctgctgctggtggccgcttgtgtctctgctgtccacagctcaccagaggttaacgccggtgtttccagcatccacataaccaagcctgtgcacatcctggaggaacgcagtctcctagtgctaacgcccgctggcctgacccagatgctgaaccagacccgcttcctcatggtgcttttccacaacccatcctcaaagcaatccaggaacttggcggaagagctgggcaaagctgtggagatcatgggcaaaggcaagaatgggatcggctttggcaaagtggacattaccatagagaaggagcttcagcaggagtttgggattaccaaggccccggagttgaagctgttttttgagggcaacaggtcagagcccatcagctgcaaaggagtggttgaatctgctgccttagtcgtttggttgagacgacaaattagccagaaagcatttttgttcaacagcagcgagcaggtggcagagtttgtgatatccaggcccttggtcatcgttggcttcttccaggatttagaggaagaagtagcagagttgttctatgatgtgatcaaagactttccagagctaacgtttggagtcataacgattggcaatgtcattgggcgtttccacgtcacccttgacagcgtcctggtgttcaaaaagggaaaaattgtgaaccgccaaaagcttattaatgacagtaccaacaaacaggaactcaatcgtgtcataaaacagcaccttacagattttgtgatcgaatacaacactgagaataaggatctgatttccgagttgcacatcatgagtcacatgctgctgtttgtctccaaaagctccgagtcatatggtatcataattcagcattataagctggcatcaaaggaattccaaaacaagatccttttcatccttgtggatgcagacgaacccagaaatggacgtgtcttcaagtacttccgggtcacagaggtcgatatcccatccgtccaaatcctaaacttgagctctgacgccaggtacaaaatgccttcagatgacataacctacgaaagcctcaagaaatttggccgcagcttcctgagtaaaaatgccacaaaacatcaatccagtgaagagattccaaaatactgggaccagggactggttaagcagctcgtggggaagaacttcaacgtagtcgtctttgacaaagaaaaggacgtatttgtgatgttctatgcaccctggtctaaaaagtgcaagatgctgttcccactgttggaggaattgggcagaaaatatcaaaaccactccacaattatcattgccaagatcgatgtcacagcaaatgacattcagctgatgtacctggaccggtacccattcttcaggctgttccccagcggctctcaacaagctgtcctgtataagggagaacacaccctgaagggcttctctgacttcctggaaagccacatcaaaactaagattgaggatgaggatgagctgttgtctgttgagcaaaatgaagtgatagaagaggaagtgctagctgaggaaaaggaggtgcctatgatgaggaaagggttacctgaacagcagtcgcctgagctggagaacatgaccaagtacgtatccaagctggaagagcccgctgggaagaagaaaacatctgaggaggtggtggtggtggtggctaagccaaagggacctccagtgcaaaagaagaaaccaaaagtcaaggaagaactttagcttctccaataccaggaaaaaagatgcttattttccagatcctggcatcattttctgaatggattgattccaataaaagcatatatcattgtggtagggtaggtggggcgggggtaggggtggataataaagcctctgagtgtccttgg

SEQ ID NO: 170547 - DNA, 600 bp, Homo sapiens
  Payload ID: 13573
  Gene Symbol: PDILT
  Gene Name: protein disulfide isomerase-like, testis expressed
  ENST ID: ENST00000575561
  CDS Start-End: 69-600
acccccagcacagccccaccttggccccaggaaccctgggagtggccttggcttcctgcaggacagccatggacctactctggatgcccctgctgctggtggccgcttgtgtctctgctgtccacagctcaccagaggttaacgccggtgtttccagcatccacataaccaagcctgtgcacatcctggaggaacgcagtctcctagtgctaacgcccgctggcctgacccagatgctgaaccagacccgcttcctcatggtgcttttccatgaagttttgctcttgttgcccaggctgaaatacaatggtgcaatcttggctcaccgcaacctccacctcccaggttccagcgattctcctgcctcagcctcccaagtagctgggattacagacaacccatcctcaaagcaatccaggaacttggcggaagagctgggcaaagctgtggagatcatgggcaaaggcaagaatgggatcggctttggcaaagtggacattaccatagagaaggagcttcagcaggagtttgggattaccaaggccccggagttgaagctgttttttgagggcaacaggtcagagcccatcagctgcaaag

SEQ ID NO: 170548 - DNA, 903 bp, Homo sapiens
  Payload ID: 13574
  Gene Symbol: PGGT1B
  Gene Name: protein geranylgeranyltransferase type I, beta subunit
  Uniprot ID: P53609
  ENST ID: ENST00000379615
  CDS Start-End: 1-903
atggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatga

SEQ ID NO: 170549 - DNA, 9545 bp, Homo sapiens
  Payload ID: 13574
  Gene Symbol: PGGT1B
  Gene Name: protein geranylgeranyltransferase type I, beta subunit
  Uniprot ID: P53609
  ENST ID: ENST00000419445
  CDS Start-End: 22-1155
ggacgtcgcttccggagcagcatggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgtcctatgacaatggactggcacagggagctggacttgaatctcatggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaagcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagttttgtgctatgtgggtcatttatctagacattgctgtggtgaataccagttatgtttgattttattctcaaatcattagttgcctttttttttttttttttttttttgctttctaggaagaaaacaatcttttttatctagaaggaaagatactttgtgttttcatttttagccatttgaagtttttaatttattgcccccagtgtgttagctgctctaatttcaaactaatacttttctaatttttttcaaattaaataagtaaaaaatacaaaaacagaaccattcaaacagattcagtggtgtaactcaatacatggtcatttttattctcatattttcaggtaagtgaaagggaaatgcgaccatttagagggtaagaaatagggttttgtttttgttcattgttttgttttaagtctatgaactagctaattataaaggaggtagtataaaaactcttcattagtaattaatttatcaataactcatatccgttacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctgatggtgggggaaaaagtaagcttaataacagatgttatccgtctatgggttattccagttgctactatttaaatcctggcagattaagacatccatatctcaaactaagtcatctcttagacattggaagttaaagtagcatatatataatggctttaggactatataaaaagcccaaattgttttttctgtatcaccaagaaaggttagaaggcaataaaggtagtaacagtgattttattcataaatgttagagaaaaattccaatctaaaagtatttcataaggctaaatattttctaactcctgataatttaataccataagattataaattttagtatgcttctaattgatacacttgtgggagactttcttgtgaaactttatggactagtaaatgttcacattccacagcaactgaattgaccagaaaatagcagcccagtgtgaattgtggagaaactatttctaacttttctaaatagttatttacaagaaaagcatttatcgattaaataaattataagcaatatttcacatatacactttattccttaacaggagcgatgtaatgagggaaaatacgaagtccgaaatctcaaaaagctctgttacctactctatacttgtctccttcccgccccctaattttgtggcattttttttttagaaggtaggaggaggagctttattttgagcatctgtgtacaaatgagattaatcagatcatatggcctaatttaacctgtttatcatttcagtgtttttagatttgatctataatatatatgtgttattagatctttagttatttatatttaatctaaattcatatagaaatcttgctgacagtggtatataatttgaaaactgttggacctgatcatttttgagagacagttaatgaggaggtgctctggaatcagatgacctgggtttaaatcccagatttgccagttcagcagcatgatcttggaccctaactctgccgtggataaaataagggtaaaacctaacacacagggtttaggattaaatgagataatacagataaagcacttaggatagtacctggaatacagcaaatttcaaattataggttctttataatgatcataaaattatttttgtaattaaaacctctcttctacaacagaaagaggtcttaacagtttaacctcagggaaaatgatgacaacagtgttgttttctaatctccccataagaatacagagcaactaggatagccacagacactattacaacgctagatgacaaggtatctctatgaacttcaaaatacaactaagtgaggacaaaccactgaaccacatagtttcagtatctgtgggaggaagtagaaggaaggcagctggtttctgacagctctgcaaattggagaactacaacactgcccacagtttctcaactacaaagtgcagcgggccaatctaagaacagacactgaaactgggaagtgactacagaatctcatttgcagatgaatgttaaagcaatatgataaggtctgctgattgcattagagctgtctgggttttacgctgtgtacctcttgaagcttatgagacaaagcccagcactgaggacaaacttctagaattagaatccaaatgggcaggatgggtaaaataggacaaaggaaagaagatctagataagtattgggaagaaaggccaagacacagagacattatatatgtgtattttcatatatatatatattcttttaaatcactgtgaaaatgggagctctaaggctgtgaagtcatcctagagccactccttcctcctaaaagtacagaaaaactcatttcagttaaggggaaaaaaagagtaagtgagccaggattacagtccaactccagtcaaagttagtataagaaataagagaataaatagatcaacatcctcacagacaatgaaagcacaccggaaggacatgaccacaagacagataaaaacctaatatttgccaaaaaataaaatgcaaatatgacaggaaatttatattaattagtacagttatcaataaaagtaggaaaaggggaaaattaaccaagtaccaaacacttggagtaaaaagcaaaataaagcagaaggaaggaattaataaaagcaaaaaagaattactagtagaaaaccaaaacaatagaggcaataataaatccaagttggtgatgggtagtgcggggagttgagtcagataaactaccagctaacctatttaagaaaaaaaggaggaagcacaaatacaaaaatttaaatgacaagggggaaatagtaaaacaggaaatttgtttaaattgactattttgagcaattttacacaataaattcaaaaactattttgagaaaaatgcaaattgccaaaatttactctaggtagataaagtcacaacaaaccaattaccgtagaagaaacaaatagttaaaagtaccccttaccaaaagaagcatcaagcccagattgtttcaaggggatttctaccaaaccttttaagattaaataatcccattcttgcttaaacaattgcagagactaggaaaagaatcttgaacctcaaagtgccaaaaaaagaaaaaaaacaaataaagaaaaactcctgaattcattttataaaatgaatgtaatagcattgattcaaaaacctgacaaagatggtaccaaaaagaaaatatagagcaatctcatgaatattaataaaaagttttaatgataacattagcaaacaatccaacagcactttcaaaaggtaatcatgactaagttgggtttattgtaagaatgcaagggtagttcaatactagataatctgttactattcatattaagagttaaaaaatatcttcatctttgcagaaaagacatgatagaattgagcactcacttatgttaactatactaagtagaaattgatgaataatctattaacattgtacctctacctaaaagccagcatcttaaatttcaaagcaaaggagactttccagctgaagtcaggaacaagacatgcccactaactcctctgctacttaacaatgtgttgagagttatagccaatgaagttagacaaaataaagacgtgaattggaaaggaagaggtaaaactatttgcagatatgaatatgtatctagaaagcccaaaggaacttgttgaaaaactaaacaataaaagaacttagtaaagtagctattaaatacaatttacataaaaatatcagtaggcttcaccagacacaagtgcatactttgattccatttcggtgaagttcaaaacagacagcatctatgtatggtgtcagaaatcagcaccctctttcagtcactacctctcttcccaaaggtaagtgctgtcaaaattaccatcaattagttttgtctgtttttgaattttatatgagtggaaccatatagtatacattatttttcaactggctttaactcagtaggactgaaagagggtacaagggagactctgcggtgctggtaatgttctgtttcatgatctaggtgctggttacgtaggtgcattcaccttatgaatatttatcaagctgtatatgatttgtgcacttttctgtatgtataattatagctcagtaaaaatgtttactaaaaagagtaacaagactatatatatatatatatatatatatatgtatgtatatgcaaacctaaactagttagaagatacttgaagagaagaccacctttgtgatagcaaaagtaaaaagaaaacttaatgtgtaaatttaagacacatctaaaatctgtatgaggaaaactaaaaaaactcttgagaggcaaaaatgtagattccaccaaatggaaagatacatgatattcttagatagacaacatcaaaacatgtctttccccacttaggttcatttataaattcagtgccattccaataaaaattatattgttatttgagagaacatactagaataaccatggaaactgaaaagaattagaggggaccagccatatccgacactaaaacatactctaaatcctccatggcagaagctatcagaattttttaaagtgtgcacactttttggcccagatactctctatctatagatttagcataaagaaacatgcaaataggcaatgatacattttcaaggatctcacagccacatttttgtaattgtgaaaaataagacacattatgatacatttatgtaactcaatactatgcaactgttaaagtatggatattggaaggcattcgtaatgttgaataaatgaaaagttttgtattggcacataaataggaagtccaatggaacagaagaggaattccagaaatagactcagtggcatttagaatacagtaaaggcagcatctcaagttagtgagaaaatgaacttttaagtaagtgctattgagattactggtgcttaattattcagatatttacaattttaaaaaatatatagcttatttcactttgaacctttttttaaaatggtcatttagttttataatttaaagaaaaatgatagttctctccccatcccagcctatactatacccacagcctatacttcctggaggtaaacaccactgttgcatacatctttcagacctttaatctctgtatatagagatatagaaatagagaatattctttaaatatctgaacatttaagtattactcatcccaatacaatatatacttatacaaatagatatatgtatgtatactatacataaagatctgaggtactaaatattccatggttttttttcattcaacaatgtattatgaatgcctttcaatagccatactttaatagttgcatagtatcacgttgcataaacatattaggtcagtgcataagtaattgcactttttaccattttaatggcaaatgaggcactgattaatcagtgccttatttttcacaactacaaaaatattgctgtgagatccttgaaaatgtataattgcccatttgcatgtttctttaaatttatagataaggaattactggggcaaaaagtgtgcacaatttaaatttgatgtttttgtttttgccaagctgctttttaagaaggttgtactaatgcacacttttatcttgacactaagattttaaatatgatcagaaaatgggtttctgatagtaaaactgtctacttgtaataattgtggcattagaaaagacctttgtggcttcgttcctcaaactcatttacgaattataaatctgaattccaaatatgaattaactcacacaagataaagctttaacagttagtagcagtactgtaactagagtgcatgttttctgtctccagaaataacattctttttatgccacatttttttaactgaggtgatcattctccaccctcttctttccatgtttttccatgtttgttcaaacttttcattaaatatcttgaggctctaactaaattaagggtggccattaaaattgtatgtgggattccctgaaccaactggtaatgcactaccagcatataaggtgtcctcattaaagcagttggtgattggtacatgggacctcactcatgtatgtttgcatctacttgtgagtcaaaaagttttcttaaagtataggtgggatcatgaaagacatacaattcactggagaaattgtgaaaaagtaaaagattatgaatttaggctcaaagccaatttccctctcatttaattctacatgagcaagtcaaggagtttggtagagctttatgaaatctctaaagattgaaggaaaacaatcactaaaatcgatttgataaagtgcaactaagtagtatgctagcctgttaatggattttcatcttgtcatttaagtttcagcaattgagtaccacactagaacacccacaaatgagattctgttacagagtatcttttttctactacagaacatactgtagacagttattcagtggttaacttgtggaaataatcagaagatgcttttcacttttatgactggatatattttaatatttatcatattaagagaaacttaggttacttacagctcataaacgttgctatgaacatcattcatttattcacttatttatttttatggtgttcctagaaagaatttcctggactaaaggatttatgctttaaaaatattggtagttactgccaagaattgccatccagaaacagtgtagccattcataaactcaacaacaaggtatgagagtgcctgtttcctcatatcctttgtgacaccggattttatcaagcttaaagttttttcattctaggtgggtgaaaatggtattccgttattgataatgtgtggaaatcaagttctaataagtttggggggaggttaattctttatatgtgctgtatgaattaatgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattagaaactctgggggtagggttagacatttgtgttttaaacaagccctccaagtggtttcaatgcacattcaaagttgagaaccaatcactgatagagaaaaagcagcttgggtagaaacagttgattatttgcaaatttatattttaaaaagataggattcttaacagtaagctctttataattcaacaatgtgatctttactcctacccccgaaaaactaatatgattttagtgtgtggtagctggatcgaaaacataataaatactcagatatgcaaagaaaa

SEQ ID NO: 170550 - DNA, 8115 bp, Homo sapiens
  Payload ID: 13575
  Gene Symbol: PIAS1
  Gene Name: protein inhibitor of activated STAT, 1
  Uniprot ID: O75925
  ENST ID: ENST00000249636
  CDS Start-End: 149-2104
ggggcttcgagcgccctgagcggggcggaggctagaggcgggctgggaaggtggaggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcacgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagaggtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtgtatatatatatacatctgtatgcacacatctttgataaaatagctatttgactagcagggttaaagtggcttttaattacttcgtgagtgttattggatacatcttaaaaaaaaaaaatctgaaccagaaccatgccatacttggttgactattttgagcattaaaattgctttactaattatttagacatgatcacaattctgtatctttactgaggaaagattcacgtaagctctgaaaaatcggattctttggcagattttcctttgagtcaagtgtctgaaatggagtgaaaatatatcctaactaaattaatgtggaaagagcatttttttagacaatttcaattttaaacacataaaactttcaagatcttcaggactttttaaagcacatttgaaattattttagtaagaattttgttttatcaatagatgttgaattctgttttttaattaaatacaaagcttagatttcagaaagagagggaaaatagctggtggtcccagagtgtgctgctgttaattgtttaacaaaggggaaaatgtacataaacagataaagttaccataaattccatgaacttaaatctgtgattcattgccttaaaactttctctcttagaatttccataccgcatgccaaaccagtaaaatggcttttaaaaatgtatagtagacaatgtcagtttgtataaaagtaccaagtgaaaatatttattacatgcattggaaaaaaattgtttacctattgaatgttacctgtttatgtagagctctttagatgtaataaaagaaaagccttcagttaatttgtcttctgtaaaataacactgctggatgttcaaggggacaatccctatgagacaagtgataatggtttgtgcttccaaagcacctttcatccagagatttcaaagcatgacaagtaactaactaattttcttgcagcatgctttgaggtaagtaatgaatatagccatcatttccctttcttgttgaaatatggctaactctttaataaatcacagcatctgtttagtatctgcagtttgaatgctaagagcaccgtggccttcttgtaaacaacactaggtgctagagaaaccagctggaatttcaggaatgagcttgaaaccaggaccaggagtaaggtaacagcccttcctcgggtagaggtttgaatcaaacacttaataggatcttagactctggaccactgaatcccttaatgagcagggagtccgtgaagaggagccccaggttctaatgaccattccacaccaactgtgtgtttttggcaagttatatttcagattcctgttaggcaaatgagattcataaaacttgctttaaaaccatactgggactattcagtgataaatatagacatagaaaagctttgacggaaagtaccctcatttattatatccagaacttgctcttcctgtgccatctaaatcattggtatctatctcccatctaatctttggtattccaggttggctgtgcaggatttacttcctaatgtccatgactggagctcaaaagaactgtgggcctaggacctttgagctttgcctgaaagtgacagcagttctctcggcggggccagcatctaaccggccctctggtggatttaccatgaaggtaatgaagtttaagcaccaggacccttcacttgttctggtcctaggagcagccccagaaattctgcatttctgtttttgtattcttaaggcagccaaatctcgtaaacctcagaccccacaaaacatctgctcctacactgtgtggacctgggcttcccagccagatggtcacaacttcacctagttggcatttgggccatttatttaccctcaccccacaaaactctttggctcctaggaattcctcctctccttgcagttatgcttggggaaatgagagtctccttcctcagggccttgtttgggtctgaagccacacagcatcgttgagacagttgcactaacactacaactcttgttccctgcagttttccctgtgcccggtgcctagtgaaagatttgtgtcttgtacatcctcccaaaagacacatcccatttgatttggttttcttctactttagccactgtggtactactagacaaagccacagcccagagaacccacttttgatacatacatggatgcaaatctttgtacttgaagccctgcacccctacctgtgttggtgtggtactccagcccttttaggactgtgctggcactacgaatgatccagatttgacaagtgtatggcacctctgaatctctggcagcaccaacctggcaccttctagctgtgtaactcactcaaagccactccagctggatggactcccagaaagcctagtgctcctactactgttttccagggctgttgtaccctggccattgctggttacatccccttatttctctccgtaagtcctggggaggtggcttaaggcaatgaccagtgtgggccacttgagcagaccatcccggaacctctctgcctgttaacagagcccagggaacagctcggaattctcacagcattggaagcccccttcttgagctctgcaaggccagtcaatttagcagctcacatctggtttcctttggtgtggggtgtaaagtagatcgctcttcctgctctcagctgatgctgcctcattgtagcatgtgttttcactctagtgttttcactctacactctgtgtttatgaatgaatagcctgagctatgtcactatatctgttgagatggaaatgagaatttgtaaatgggcctctggcactgcaagaattgttgtcataagtgttacagctttctgttcattgctgcttctcagctagcactggcttcatcttggaaaatcttggaaatatggaagatggttctagcccccaaatacagaataagtctcttggtagattgcccttaagtcatcagctcaatccttcctcaacaggctccatgaggtaagaagtgggaatccagcttgtgtgggggggctttgaggagtgaaatgatttgcccaaagtcacagtgggaagcagcagagccaggactggaacccaggccagactccaaaccgcaggctccttccatgcttgaaagggccggactcacggtagttaataaaatcaatacaaatcttttattaaagatctactcatacc

SEQ ID NO: 170551 - DNA, 2932 bp, Homo sapiens
  Payload ID: 13575
  Gene Symbol: PIAS1
  Gene Name: protein inhibitor of activated STAT, 1
  Uniprot ID: O75925
  ENST ID: ENST00000545237
  CDS Start-End: 742-2703
ttgttgtgggcgcctctggcgggggtggcgggggaagagatagggagtccggaggtaggggctgcagctgtctcatgggctcggctttttcaccttccagttagcctccctgccccccatggggagctggggctgggggcagggtgctctcgtaggggggattgggaaagctccccgtggccgcttcctcttcctcctttgcagtcccgggctcctgtcaggcgctcttctcagacccccgggaacttggcttcggccgccccgcccctccgtggatcccagtagcccccgccccggactcggctttccccggctgctcgcttgtcaggaagcgcctggggtgccccgcttgtgggaagcgcgatcccggggcgatagggtggggatctgggggagaagctctggtaaagtttagcgagccccgggccggcgttggggttcggctgagaggtagtgagcgggacgttactctttctctctgattccgggcagccgaggggagaaaccccctcgaagagtgtgtctttggaagcagtgttgggagggggggatgcagctacctctctcccttcttttgccttagctggtgtggagggtgagaggagcctttgggggtctctgcacacaccatgatggcgatgctgtagctgatggagaacaaccaaatgccagatttgattctgtagagtttttcctgtggaatatcctcaccgaaagagcttttctcctaataacttcacaatgtttacactccaagattcgtatgttaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgttt

SEQ ID NO: 170552 - DNA, 1168 bp, Homo sapiens
  Payload ID: 13575
  Gene Symbol: PIAS1
  Gene Name: protein inhibitor of activated STAT, 1
  ENST ID: ENST00000563996
  CDS Start-End: 1-194
gcattttaagtcttccacatcaagcatctccagtatcccgcaccccaagccttcctgctgtagacacaagctacattaatacctccctcatccaagactataggcatcctttccacatgacacccatgccttacgacttacaagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaggaaagaaaagaaaaaagaaaaacaagcacccacaaaccaccttcagttcatttttttctggattctgaagatttttcattatttgtcctatggttttggttttatttgacttcgatggcattattttatttgcaataacagaaaaggaattgcatgagagaaatatgagttggagggaaggaaaagtggttctactaatgttccaaaatcctcatcagagaagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtgtatatatatatacatctgtatgcacacatctttgataaaatagctatttgactagcagggttaaagtggcttttaattacttcgtgagtgttattggatacatctt

SEQ ID NO: 170553 - DNA, 671 bp, Homo sapiens
  Payload ID: 13575
  Gene Symbol: PIAS1
  Gene Name: protein inhibitor of activated STAT, 1
  ENST ID: ENST00000564915
  CDS Start-End: 19-501
tgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcagaaattatctgaatacacgaagattataggagtcattttcaaacaaccatcagacaacagtcagcgctttcgagaaacctgttttgcatttgccttgacaccacaacaagtgcagcaaatcagtagttccatggatatttctgggaccaaatgtgacttcacagtacaggtccagttaaggt

SEQ ID NO: 170554 - DNA, 766 bp, Homo sapiens
  Payload ID: 13575
  Gene Symbol: PIAS1
  Gene Name: protein inhibitor of activated STAT, 1
  ENST ID: ENST00000562190
  CDS Start-End: 10-72
agacgcaagatggcggacagtgcggaactaaaggaagaagagtgggagagaagaagtccatcagcattttagtggagtaaataatgaaattaaatgggaagagaaaccataattataaaagttactatgagtgttagtgtcacatgaaaagaaaattccctagaacccttccttcagagttttctgcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggt

SEQ ID NO: 170555 - DNA, 4543 bp, Homo sapiens
  Payload ID: 13576
  Gene Symbol: PIAS2
  Gene Name: protein inhibitor of activated STAT, 2
  Uniprot ID: O75928
  ENST ID: ENST00000324794
  CDS Start-End: 159-1877
gacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgtatttatggagtggaaaacagcttatttcaaggaaaaatatgactgccttattattgctagtgccatattgtcaggtgcgaatggtgctcaaaagttgtatcattaaaatttgaaagtgctaaacatttacatatttaatcatgtagcagttatgttttgttaaaagtttatgactcaaataaggaaaatgtgttgtcatcaatgagaaaaaatctaatgagtcaatttcacagtgaagcacttaaaatttttaaattaaaattttatcagtgttaataaaataatgttaacactacctgctttttagttaaaagtaattgagcattttcaaccatgaaatacttcggagggcataaaaatatatcagtatgacacgctgcagttgaaacttatggtgaaataagaaacagcattttgctaaacttacgaaacaaggcagtaaaattttaatcactactgatgaaacttgattttatataagagttttaatattctgcttaaaatgtaaaatgcaagaagactttgatggtttcgttttttgttagaaagaataacatctaaaataccatatcaaacttcactgttagtacttgagaaaaaaatggtttcagtgagagaaatatttacattaaacaggttttatatagacagcacccttgtaatgcttggtaaacaatctagaattccaaccaatattttagaaaaatttctaggtattttattatggtgttgtataagtcaccacattcaattttccgtggatgaggtatcaatatacagataagtaaatctcttaattgttttctaaataaactttatatttaccacacacatgaaatcatcaaagagaattacagtacatctgaagaactggaattgaaataacaaaaataggatcctcagtgggtattctctggtgatagagcttcaatttttaatttcaattaaaataaataggcttgatataattttcaaactgttttatatcaagcttgcgtattttaattgaaattctgaaattgaaatagttgaacatttagaaaatgagcatttttgagtggcttggcttcagtacacaatattccaacaccattgtcaatacttagcgttataaaaaggtttcagttactaacatgaactgagagatacagcaaatattaaagatgattgaacatatgaaactgaaaaactataaaaaggtagaagctattgtaaaaatgaagaaaactgaaaaactgaaaagataagaagttactgtaaaaagaaaacggttataccatttgaagcagaacaaaatgttccaataaactttttttacttaataatagaaatattgaaaatgcaaaactctgaaggtattacaagggctagacaaattttgaattgtttggcataagaagggagaggatttattgaatattattaatatgaagacaaaatctgcttattgagatatctcacctattatcattttaatagagaagtcattggaaaagtttgttgtaattctctttggtttagtattggctcaaaccactgtgtcatatagctagtgacagacatatgaaatgaaaaattacagcaagctgggtgcggtggcttatgtctgtaatcccagcactttgggaggctgaggcgggaggatcacttgagctctggagttcaaaaccaacctaggcaacatagcgagaccctctctctacaaaaaaaaaataataataataattagctgggcatagtgacacacacctgtagctcctgcttcttgcgaagctgaggccagaaggtaaaggctacagttacctatgattgtgcctctgcactccagcctgggcaacagagcagactcagtgtctcccaaaaaaaggaaaaaaaaaaaatctgtagcaacaattttcaaaaaggctttagaaatcgttggaatgatttctttcaaatgattggtgctatagcttgtatcacttgataagcatttttgtaatacccttatttggagattataagagaataaatatacttaaattttttgagttataaattcatactggttagtagatattttaaatgtacccactgatattctctattttgcataaaagcataatgtcagactttctctgtgtggtggttatattcggggtgtctctgaatgccagcataaaaattcacggaattgaatagaaattggcctgtcttaatgacctatggtttcttttttaatgttttgaaataattaaagagagtttagtcacacagggaggtctaggtgaactgatgttgaagtttattactagacttttcagacctaaaaattttatttattgttattacttgaatatgtcaaaagtatattactggacaaccttttacacattcctctttctaaaatcgaattggacaattacagttctctggttcagaaaattacattagctcagaacccagtaacccttgataaccctgttagcgcagcaattcccgagtgtgtgctttgtgcagagcgttggactatgtactgctcttgatgtggggacagcggggacagagagctgtcattgaaatagacatctgtttaagaagcgatacttagatgaacctctgtatttctgaaaaataaatgtgaaatatcttaagagcttaa

SEQ ID NO: 170556 - DNA, 2043 bp, Homo sapiens
  Payload ID: 13576
  Gene Symbol: PIAS2
  Gene Name: protein inhibitor of activated STAT, 2
  ENST ID: ENST00000398654
  CDS Start-End: 110-658
agtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacaga

SEQ ID NO: 170557 - DNA, 1590 bp, Homo sapiens
  Payload ID: 13576
  Gene Symbol: PIAS2
  Gene Name: protein inhibitor of activated STAT, 2
  ENST ID: ENST00000545673
  CDS Start-End: 556-1404
gtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgtatttatggagtggaaaacagcttatttcaaggaaaaatatgactgccttattattgctagtgccatattgtcaggtgcgaatggtgctcaaaagttgtatcattaaaatttgaaagtgctaaacatttacatatttaatcatgtagcagttatgttttgtt

SEQ ID NO: 170558 - DNA, 561 bp, Homo sapiens
  Payload ID: 13576
  Gene Symbol: PIAS2
  Gene Name: protein inhibitor of activated STAT, 2
  ENST ID: ENST00000589917
  CDS Start-End: 196-561
aacctacccaacccatccaggagctgctacacattgaggaaggggcagaatgaatgctgggaagcaactacaaagaacactgcactggctgtaccattttacatccctaccagcaatgtatggagtgatccagtttctcagcatcctcgccagcatttggtgttatcagtgtttttcattttagccattctgaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgag

SEQ ID NO: 170559 - DNA, 11075 bp, Homo sapiens
  Payload ID: 13576
  Gene Symbol: PIAS2
  Gene Name: protein inhibitor of activated STAT, 2
  Uniprot ID: O75928
  ENST ID: ENST00000585916
  CDS Start-End: 1-1866
atggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagattttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttctttcaccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattggggcttacgttgtttatctgtcttgagcattagtactttatgactttggccttatggcaacatcatgattattaatccgtcagcctttaatgtggtcactgtttcttatccagaccctgactttctagtagtttattttgctagcccagatttctgcttaaccaaatataagggagtttcagaggggtgatcttagctgtcacctagattctgtcagccaaccagtgattgtctggaatatcttaggaaatgaactgtaattgtcagcctcctaaaatcaatttttttttttttttttttgaggctgagtcttgctcttgttgcccgggatggagtgcaatggtgcgatcttggctcaccgcaacctccacctacagggttcaagcgattctcctgcctcagcctcccgagtagctgggattacaggcatgtatcaccacgcccagctaattttgtatttttagtagatacggggtttctccattttggtcaggctggtctcgaactcccgacctcaggtgatccgcctgccttggcctcccaaagtgctgggatttacaggcgtgagccaccgcgcctggccaaaataaaatgtttttatctttcttcacttagaactatgaaggccttttcttgttctggtaaccccccacagtgtaattggtgctgaaaatagtttcgtgcctgaggtctgttgtcactcactcactttctgacaattaggtgagccacttgaggattttctggcctgaagttataaaaacttggcatctgtcctaaggtaattgtaaaggcaaaatgaaagcattgaggtgaatttaggttatatggcatttatctggtaatgtgtttcagaaaagctagaatgaaaatgtgatgtaagggatagcaagtgtaggttgattcataattcttggtataaaaccaagttttccttagtcttgaggaatttgaagaaaggtaaaatgttggattttaagcaaagtaggattgaccagagactgttctgactttgacattcagacctttcagatgttcttccttcagaccagtccaagacactcagcatttccagccaagttgtcttttttttctgccaataaagtattcattagttgacgtttgtttgtattttaagtaaagtcaattttttttaaagcattaatttaattcacgggtatgcctttcatttctctggccttcagttggtttaaaaaaaaaaaaaaaaaaaaaagcacttagccggaccattctttctttagtaaacatttttattttcttaatttttcctgaaagattttcttcattttcatggaatgtcataatgacactaccattattttctagctctttgcataatagaaaaatgtagagcagtgcaccatttaaacacgtctgacattggatttagtggtcctaggttcatgtgatttgggagccttaagttgttatttagattgattcagcctgattcaccatcttttttactacagttctacatgaatgtggtgaaacaggtagaagaaaattaagcatttctctgcttttggagtctaatgttcctgcctagtgactggtttgtaacacccccctcacccctactttgttaggaacctgcaattcctaaaagaaataaataaagctgtacccaatgtccattctttaatgcttgcctggttgaataatgtttgttttttctgtttatgtcagtagtacatgcttattgtggaaaatttagacaatacagaaaagtataacaattaattgcctatgattctgtcaccagaaaaaatcacttgatatttttgcatcttccttgccattgtctttgctacttctgcatatttttacttagtttcatcattctcagtgtaatttatatcttggggtttttccccgcaacctacaggcattattccatgtcattaaaactgtgtcaactattattaattttatggtactccattgttatggatgtgccatgtttcatataacctttacttattttgaacagtttagattatatctcataatgccacaatgaatgtctttgtgtataaattattttcttaggataaaatactggaggtggaatttctagtcaagggtatatgaacacttttgtagttcttgattcataccacttttccacatgggtatgttaatttatactgcagctagatggtatgggaagggtggtctagccatattttccaagaacatgcaacgttttatctttatgcaggcatctgcactaagaccctctgcctttctgactctatggaacggggttaactgatatggagatcattggcagagattttcccaagctttcttagttttaaatatatctgacatgggccgggtatggaggctcacgcctgtaatcccagcactttgggaggccaaggcgggcagataatctgaagtcaggagttggagaccagcctggctaacatggaacatggtgaaaccccatctctagcaaaaacataaattaggtgggtgtgatggcaggcgcctgtagtcccagctacttgggagaccgaggcaggagaatcgcttgaacccaggaggcggaggatttgcagtgatccgagattgtgccactgcactccagcctgggtaacaaagcaagactctctaaaaaaaaaaaaaaaaaaaaaaaaaaatatatatatatatatatatatatatataaaatctgacatgtttcagaaacacctacgtatggctatccaagcttttcccatgattttactggcactgtaaagttgcacaaatattctttgtcagactacgttttccatctttagttcaaaagttttgtcactttttaaaaaaagcctcttgtacctaaggcctgcccttaagaggtcagctctctttttcctcttcctgtaggccccattatggcctttctgagctccccaaagccagtagaatctactgagccaaaggcattccatccccaaactgaaaagtggtaaggctaaaagctataaaaacaggcaaacattgcctgttttcactttatattcccttatgtttccaataagggtagctgcagggaaagaaaaaaacagattgctaccttcagatgtttgaggtacaacattttcttgattggcgtagcacaatcatttcccaaactgcttcctatttctgaatggcttttttaaaaagctttattttgtgttctcaaagcttaattattttaagtgacgaagagtgttaccgtgttgtagaatagcatatgcctcttattttggccttcatcaaactgtttaataaatgtttagagtgttttgtaagtacacgtggaatagagtgttacagaagttttggttccagacatcaggcagcttataatcaaggttccaaaaatcaagaattcttaagctgggcatggtggctcatgcctgtaatcccagcactttgggaagccaaggcaggcaaatcacttgaggccaggagtttgagaccagcctggccaacttggtaaaaccccatctctactaaaaatacaaaaaattagggcatgatggctcatgtctgtaatcccagctacttgggaggctgagggatgagaattgcttgaacctgagaggcggaggttgcagtgactcaggatcatgaccctgtactccagcctgggtgacagagtgagaccaaaaaaaaaaaaaaaaaaaaaaaaaaaaagtaacaggcattgtgcaaagaattttccaagaatgtctcattcttgcaatggcttctcagaggaaagtggtgttattccccattttacaaatgaaacaggtttaggtaagtttcccaaggtcacagtgaatgagtagtggacttgggagtctgacctagacttaccccaaaagctctctgcgtaaactgaagtgacgttaattagctgtgctatctaggagactgatatgggaatctagacttaaaattatgagaactggtttcagatgatggccagagtaataaggaaggagtggatgctgaagccatttcaaaggaagactcaagattcagtgactgaatataggagtaagggttgagtgcatttttcatccatttttcaagcctgggtaacttggatgttaatggcactatctacagagacaggaggcagtttagagtgaagacgaatcatgtatgggagacagtgatgaatgttaagcatgggatttcagaaatgaagcatccatgaggctcattcctggtttttctgcagtcttttaaataaaagtacaaacctcccttgtcatccatttttgccttcacttatctccattctgtattatgttctagtcacgccccagtcactgatcccttcctaggccatacttggctacatcttagccttttcttttgatttttctcttcactgccttgcccattacaaatttggctgccacctgaggccctgccataccctacagctcacaccagcgtgggctgtgttcacattctacatatctcaagatacagtggttgctgtccttcccccctactgcatcgttacacgtctctaaaaaatctctgcctctgaagctcatgccaagaggttatactatcagctacctctagtcttataactgcctgatcattccctttgatttgctggaagctttgactcacagtgttccttgccttccttgattctggtcattattattaatatcttgaacattctatagatgatttatccaagttggtctgtgaggtattggttactttacctccagcattttcgtctactgaaccacgctttctgttttcctctttgctacttgtccagactgttctttcattattgcagccttgaagaaatcctcagtaacctatccatcctccgacatgacgtagcatagttcctttgcccattctcatcagttataacaaatgttattgccctcttttcaggccacttccttctcagaagatgactttgctgcttaattcaaacagaagggacagtccgaaagcatgatttcttccccacctatgaccacctccatccttttttgtttccagtttcagagaatgaggtaggcctttaaggccaactgactctggtctcctcctgtcatcttcaggaccttcctctgtcagacttcccctctcttatctccatgtctctcacctctctactgctgcttttcttggcttacaaatggtctcagtcatccagtatttgagattatattaggtgccaggcattgtatcaggcacttggaacacaaggcaggatcctgcccccaccaaagttgtgctccaatagcgtcaacagaggtgtgaaatagggagattacaatgttaatggtaaaagacaaagtatagggtgctacaagagcatgtaaatgaggcacctcaatgatttaatagaagtaatgtggagaaatgtgaggattgatgaaaagcttgtccaaaaagggccagaaatgtttagaattgctggaagtttgctaaggaatattgagaaatatgcatagatagatcgtgaagggccttgtaaaacagtgatgagacattgaagagttttcatgatcattagtagtaatgagaatttgttgagtttggcatgattatctccatattacaaatgtggaaacagattctgacaggataagcgacttacttgcccagggtcatgcagcttgtaattgaggagtcaggtttcaaatccagttttaactactttctcagaggcctttcttgatcattctatctaaaaagcaagtgttccctaactattatcccagtaccctggtttatatactcttaatacataaaataatccctgcatattgtgtgtttcccctactagattgtaagctccatgagggcagaggtgataacttttttcacttgcatcccagagcctaacatgatatgggctacatagaaggtgcccagtaaatattggtggatgaagaaatggtggataaccatttgcatttgacttatgctgactggaaattcaatacctttggaatatataatacctcagcagtaagcattcaccaagagaggaaaacagaaggaggtgcatgtttagggtaggtggtacgggagatggatgctgaggtgttgaaaggcagcatactcaccttctgaactccaaaacttacaggggcaagggccattaatgaggggtgggtagagcagtgcacagtggggataatatgggagtaggtgtattaaacctggaagtgtaagcaactccttgtagacccaccctactgtgtataaaaggctggagaaattcttcatatgatctactctaggttatgtactgaggaccaccttatctgggtcaggtacactacacagagtgctacaatataattgtaaacataatttatcctcactgtgatggctagccacctgacccaaatcattattagactcaatactttggaactggaacaaaaatcagttgacctgatgtctgaaagacatgcccacctgctatttgacaagctatagacatatcctaccaattgatgggtagtagcactgaaactatgaaagtggatgaactcatccagaggagttgatgagtgagaaaagaagactggaaaaggaacacaaggaaatcaagaagcagcagctgagactgaaggaaaataacgtggtattacagaggccaaaaaatagagtatttcaagaagcaagtggttagtggagttaaaagctgctgatacaacctaaaaaagtaagtatccattttttaaaaaactttcatttaaaataccaccatattttattgaatctaagtacctgattgtaagacattaaagaaaaattaaacctgctaattaaa

SEQ ID NO: 170560 - DNA, 502 bp, Homo sapiens
  Payload ID: 13576
  Gene Symbol: PIAS2
  Gene Name: protein inhibitor of activated STAT, 2
  ENST ID: ENST00000592221
  CDS Start-End: 234-502
gaccttcaggtgcccttcaaggtcagaaaaactcggcaaggatctccagtacaatgttgaatagaagctgtgatgggggcatcctgatcttgttcctgattttaaagggaatgctttcaaagtttcacaagttaacatcttaaagaccatagtacagtatcacaaccaggatattgacatgaacacaatcaagatatagaccattttatcaccacaaggatccctctctccaaatggctgtaccattttacatccctaccagcaatgtatggagtgatccagtttctcagcatcctcgccagcatttggtgttatcagtgtttttcattttagccattctgaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatag

SEQ ID NO: 170561 - DNA, 447 bp, Homo sapiens
  Payload ID: 13576
  Gene Symbol: PIAS2
  Gene Name: protein inhibitor of activated STAT, 2
  ENST ID: ENST00000587810
  CDS Start-End: 161-447
agtcaaacctacccaacccatccaggagctgctacacattgaggaaggggcagaatgaatgctgggaagcaactacaaagaacactgcacgatctccagtacaatgttgaatagaagctgtgatgggggcatcctgatcttgttcctgattttaaagggaatgctttcaaagtttcacatggctgtaccattttacatccctaccagcaatgtatggagtgatccagtttctcagcatcctcgccagcatttggtgttatcagtgtttttcattttagccattctgaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatag

SEQ ID NO: 170562 - DNA, 497 bp, Homo sapiens
  Payload ID: 13576
  Gene Symbol: PIAS2
  Gene Name: protein inhibitor of activated STAT, 2
  ENST ID: ENST00000586953
  CDS Start-End: 234-497
gtggtccgcacacctggcgcggggggtcggggcgccctccaggaggggcacatggggacccgacatcccggttcgcagtgagggccgatgtgggaagcaacgtttgatcttgcaccttcaccggggtgtacgtgtctgtggctattcacaagtctgcatgctactcacttggtggaggactgttttctgaaagctgaagttgcgtttaggaatctctcctcttcttatggctgatgctaccgtttagtcagaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatca

SEQ ID NO: 170563 - DNA, 2790 bp, Homo sapiens
  Payload ID: 13576
  Gene Symbol: PIAS2
  Gene Name: protein inhibitor of activated STAT, 2
  ENST ID: ENST00000592212
  CDS Start-End: 1-1611
cacatggctgtaccattttacatccctaccagcaatgtatggagtgatccagtttctcagcatcctcgccagcatttggtgttatcagtgtttttcattttagccattctgaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaagggtttgttaatttatagttcactattgttcattacccttgcaactaattgctcttggatagatttataaatgtctctttgggaaatggcataactgtagaaggctattttaatttgcctttgttgagttgaaatattttcgagtaagcacattgtttataggaagcaaattttgatggagaaaatatttacatctttggaaagtgagcgtgtgaggtatttatttcctacctgagactttttgttattttcttgaacctgtttgtaaggaaatttggcatctcagaccagatgagaaagtctggtgtaatggagtgtggaactgggaatctgacaagtatggattccaattttggcacaccatcgcttacttgttctgtgatcttagatgaaatacttaatttgattgagcctcttttttgtgttctgttaaatggagctaaataacgcctatattacaggatcattttcaggttttaatgagatgaaagaaagcctcggtgtcaggcatgtggtaatttcccaataaaaattgattcctttcccttttcaccctctccagggcaaaatataggtgggtaggatggcattctacctgaattttagcgtggattctctgtaagttatctggcagaaggcattactgacctgcattaaaaatcaggtttgggtatttaacaatagttgctttttcagagaggttttgaaccataaaaggagataacaggagagttctcctggctgtctacgaacacattctttcaaacttgggtttgctagtgtcatctttttggcctcttggtccacttggttttctaatggctttactgagttataatttacatagcataaaatgtacccatcttaagtatataatggcacaattcagtgattttagtaaatacatagagctgtgcaatcatcaccatgattcagtagtagaatattttcaacacccaaaaaactttcttcatgttcttttgtagtttattcctatttacaccccaaatctaggcaatcgtttttttgtgtctataatgcctgtttagacattttatataaaatgtcttgttttgcaacattgtttatttttataattttaagaattaaaccttttcagctgccttctttgctgttaaaatacttacatttccaaatataatttacacatatattaaaggcatatatttacttcta

SEQ ID NO: 170564 - DNA, 2761 bp, Homo sapiens
  Payload ID: 13577
  Gene Symbol: PIAS3
  Gene Name: protein inhibitor of activated STAT, 3
  ENST ID: ENST00000369298
  CDS Start-End: 56-1837
gccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 170565 - DNA, 2901 bp, Homo sapiens
  Payload ID: 13577
  Gene Symbol: PIAS3
  Gene Name: protein inhibitor of activated STAT, 3
  Uniprot ID: Q9Y6X2
  ENST ID: ENST00000393045
  CDS Start-End: 91-1977
gcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 170566 - DNA, 952 bp, Homo sapiens
  Payload ID: 13577
  Gene Symbol: PIAS3
  Gene Name: protein inhibitor of activated STAT, 3
  ENST ID: ENST00000393046
  CDS Start-End: 176-952
gctaggccgggcggagctccggcccgggcggagccgcggccgccgcgtccggctgctggaccgaacttctgccgtgcggacagcaggagcagcgccgagccccattcccccacctctccagctcgccctctgagcctcccgagccctctctccatttcccacaattgtgctgcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacgg

SEQ ID NO: 170567 - DNA, 429 bp, Homo sapiens
  Payload ID: 13577
  Gene Symbol: PIAS3
  Gene Name: protein inhibitor of activated STAT, 3
  ENST ID: ENST00000463514
  CDS Start-End: 154-429
gcgccgagccccattcccccacctctccagctcgccctctgagcctcccgagccctctctccatttcccacaattgtgctggaggctgggatgggtttgagagtctgagaaagggcaagagaggagataagcagcttaaagcagagtccagggatggaggcgggaggctgcatggactcggagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccct

SEQ ID NO: 170568 - DNA, 3159 bp, Homo sapiens
  Payload ID: 13578
  Gene Symbol: PIAS4
  Gene Name: protein inhibitor of activated STAT, 4
  Uniprot ID: Q8N2W9
  ENST ID: ENST00000262971
  CDS Start-End: 116-1648
ggaggagcgcgcgcgggtgctaattggcccgggcggcggccccgcccgcgagtggtgagcggtcacgtgacgcgacggctgggggctcccggcgcgggggacgctggtgaccaagatggcggcggagctggtggaggccaaaaacatggtgatgagttttcgagtctccgaccttcagatgctcctgggtttcgtgggccggagtaagagtggactgaagcacgagctcgtcaccagggccctccagctggtgcagtttgactgtagccctgagctgttcaagaagatcaaggagctgtacgagacccgctacgccaagaagaactcggagcctgccccacagccgcaccggcccctggaccccctgaccatgcactccacctacgaccgggccggcgctgtgcccaggactccgctggcaggccccaatattgactaccccgtgctctacggaaagtacttaaacggactgggacggttgcccgccaagaccctcaagccagaagtccgcctggtgaagctgccgttctttaatatgctggatgagctgctgaagcccaccgaattagtcccacagaacaacgagaagcttcaggagagcccgtgcatcttcgcattgacgccaagacaggtggagttgatccggaactccagggaactgcagcccggagttaaagccgtgcaggtcgtcctgagaatctgttactcagacaccagctgccctcaggaggaccagtacccgcccaacatcgctgtgaaggtcaaccacagctactgctccgtcccgggctactacccctccaataagcccggggtggagcccaagaggccgtgccgccccatcaacctcacccacctcatgtacctgtcctcggccaccaaccgcatcactgtcacctgggggaactacggcaagagctactcggtggccctgtacctggtgcggcagctgacctcatcggagctgctgcagaggctgaagaccattggggtaaagcacccggagctgtgcaaggcactggtcaaggagaagctgcgccttgatcctgacagcgagatcgccaccaccggtgtgcgggtgtccctcatctgtccgctggtgaagatgcggctctccgtgccctgccgggcagagacctgtgcccacctgcagtgcttcgacgccgtcttctacctgcagatgaacgagaagaagcccacctggatgtgccccgtgtgcgacaagccagccccctacgaccagctcatcatcgacgggctcctctcgaagatcctgagcgagtgtgaggacgccgacgagatcgagtacctggtggacggctcgtggtgcccgatccgcgccgaaaaggagcgcagctgcagcccgcagggcgccatcctcgtgctgggcccctcggacgccaatgggctcctgcccgcccccagcgtcaacgggagcggtgccctgggcagcacgggtggcggcggcccggtgggcagcatggagaatgggaagccgggcgccgatgtggtggacctcacgctggacagctcatcgtcctcggaggatgaggaggaggaggaagaggaggaggaagacgaggacgaagaggggccccggcccaagcgccgctgccccttccagaagggcctggtgccggcctgctgaccccggccgcacactcgactttcctggtgctcaccacgcagaggggcacgggccagcctcgggcgcagagggaggagtgacctttctttttctttttattgtcgttcgttttgtttttccacccttttgcctggctcctggcacctgtacctctggactctcctatcgggggattaaaaaaaaaagtaaaatgacaaaaaaagatacaaaaaagaaaaatgaaacaaaaaagtcaaactcttaaaaacaaggccggccacccacacagccgcctccccggctggagtccgagccgggaaggggtagtgggcgggagggaccaggacgccgccccgcgccctcccctccggatgccccgccgcccgccgccctctgcccacgaccattccagccagtgcgcggggacccgggcggcgggcggtggggcgcagcccctctctggcgaccactttgacgtttgtctcttcctttgctttttctctgcaaatgcatcctcgcccagagaccctcacgcgccgagcagcgagcgttttagccgagaagccatggagtgggttggggcggggaggggcagtagggtggggggatgggtgggcaggatgggggtacagtgggcggctggggagggtttagccacagatgtgttgtattttttgaaagtgcaataatttggtattttgaagacccggcgtgtggtcaggaacccccggggaaggcgggggcccagggtgcggcaccgtgtggcgtgggggggtctcagttttctagccagctacctcggtaattccaattcaggttaacttccctacggaacagcacagatgtccacagatgtccacagctgccgccgccgccgccgccaccataccccggtccttggggcatgggttgcggtcgcttcccaaggggcagcagggaccccggccaccccggctctcggtttgggttgattcctctcctttttgctcttggttttccgacgggtacgaggctggcccggcaccctgtcccccgggagcctcactcttccagcaggaccagaccaggggcctccttcctgtccccaggcgttcccggcccctcgcaggccccacccatgcccttggcctcagggtccaacaactgggggagctaccagggctctgccttcaggagcccacagctgggcaccccccttgccccgcaggagaccggggcgcaggcggggcaccggcctcacctggttctccaacaccgctgcctgcggtctgttttgcttttgtcctccccagcccagaattttcctttgtataaacagaactcctagtcaggaagcaatatcatttcaggtctaaagaaagggacgtgcatctggccgagggcagttcagtctcactgcagagcccgcagcccgctgcgcagctcggcccctcccgcccgcacgggcagctgaaggccgctgttttctaatatttgtattctaatttaattgtttttaaaaaatgcaaataaaaaaggtcgaggtgaagcca

SEQ ID NO: 170569 - DNA, 1566 bp, Homo sapiens
  Payload ID: 13579
  Gene Symbol: PROCA1
  Gene Name: protein interacting with cyclin A1
  Uniprot ID: Q8NCQ7
  ENST ID: ENST00000301039
  CDS Start-End: 195-1205
gggaagactacgcagcctggagccgggctggggaggccggcgggggctgcgccagcatgaggcggggttaggggctaggcgggggcgaagccgagactggagttcacggctgggccgagggctcggccgggctgaggctcagggttggacttcacgcaagagtcctgtagagacgaagacctgggcggagagcgatgtgggtcaggacgacgctcacaattgaaagatggactaaggaaaagaccgagcccaaggcccgctcgtgggatgagagcagatgccgcggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaagccctcacaagccaggaaggtaaacaagagaaaatctcccccaggatcaaaccccaacctcagttgaggccagggtggtcagggtgcagaataaatgccatcgagcctgtggctggccctctgctgctgttctctccctccaacctggctgtttcttgcggggcaaggggtgggctcagggctgcaggggtttctcaaaggcaatccagctttcacaaaggaagcccatgggaaggcaggtgggagggaaaggaaggggcacagccctatttcttcctacctgctaggacaaggtggaagagtgtatctggggtgggaaggagggcttcccctctctgctgcgagagactggtctgtgtgaaatccacttctgggacaggcagtactgtctgcagcgatacccccaataaacggaactttttaaccca

SEQ ID NO: 170570 - DNA, 1137 bp, Homo sapiens
  Payload ID: 13579
  Gene Symbol: PROCA1
  Gene Name: protein interacting with cyclin A1
  ENST ID: ENST00000439862
  CDS Start-End: 1-1095
atgtgggtcaggacgacgctcacaattgaaagatggactaaggaaaagaccgagcccaaggcccgctcgtgggatgaggctctctcagatgtaaacaggttacccagctgggagagaggacatctgctggctggtgtggcgtccagcactgatgtgtctaccttctctgaaggtggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaagccctcacaagccaggaaggtaaacaagagaaaatctcccccaggatcaaaccccaacctcagttgaggccagggtggtcagggtgcagaataaatgccatcgagcctg

SEQ ID NO: 170571 - DNA, 848 bp, Homo sapiens
  Payload ID: 13579
  Gene Symbol: PROCA1
  Gene Name: protein interacting with cyclin A1
  ENST ID: ENST00000473751
  CDS Start-End: 23-481
acgaagacctgggcggagagcgatgtgggtcaggacgacgctcacaattgaaagatggactaaggaaaagaccgagcccaaggcccgctcgtgggatgagagcagatgccgcgatgtaaacaggttacccagctgggagagaggacatctgctggctggtgtggcgtccagcactgatgtgtctaccttctctgaaggtgactgcaaggagcctgacaagtgctgctggagacacaagcagtgcactgggcacatcatctaccctttcgcctctgactgtgtccgccacagcctgcacctacactctgtcaaccactgcaactgtaattctagctttgaattggtgctgccagcccagtcccagctctgcacaccttgctctgctctaagagaaatggggaggaggtctgttggcctgaggcaggcccagcggaagcccactgtccctcaggcttctggctctgggtccctgggggagtgatgggagccaggctgagagtcccatgtgtggcaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatc

SEQ ID NO: 170572 - DNA, 766 bp, Homo sapiens
  Payload ID: 13579
  Gene Symbol: PROCA1
  Gene Name: protein interacting with cyclin A1
  ENST ID: ENST00000581289
  CDS Start-End: 88-213
ggctgggccgagggctcggccgggctgaggctcagggttggacttcacgcaagagtcctgtagagacgaagacctgggcggagagcgatgtgggtcaggacgacgctcacaattgaaagatggactaaggaaaagaccgagcccaaggcccgctcgtgggatgagagcagatgccgcggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaa

SEQ ID NO: 170573 - DNA, 811 bp, Homo sapiens
  Payload ID: 13579
  Gene Symbol: PROCA1
  Gene Name: protein interacting with cyclin A1
  ENST ID: ENST00000415329
  CDS Start-End: 482-811
ggtggctggaagagaagaaagaagtgaagacactgagctcactgaaggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaaggaggagatggatgagaaggcaaagctgaagaaaaaagccaagaaaggccagttgactaagaagaaaagcccggttaaattggagccttccccgccagacgtgagccgatcattaagcgcaagacagctggccaggatgtccgagtccagcccagaaagccgggaagagctggagagcgaggacagttacaatggccggggg

SEQ ID NO: 170574 - DNA, 2055 bp, Homo sapiens
  Payload ID: 13580
  Gene Symbol: PICK1
  Gene Name: protein interacting with PRKCA 1
  Uniprot ID: Q9NRD5
  ENST ID: ENST00000356976
  CDS Start-End: 239-1486
aatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 170575 - DNA, 2164 bp, Homo sapiens
  Payload ID: 13580
  Gene Symbol: PICK1
  Gene Name: protein interacting with PRKCA 1
  Uniprot ID: Q9NRD5
  ENST ID: ENST00000404072
  CDS Start-End: 348-1595
ggcggggttagacgctgtcagcctgtccagaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcaggtgggttcaggtaccagcctggccgggacccggctgtgggaccaacgcttccgttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 170576 - DNA, 582 bp, Homo sapiens
  Payload ID: 13580
  Gene Symbol: PICK1
  Gene Name: protein interacting with PRKCA 1
  ENST ID: ENST00000432756
  CDS Start-End: 155-310
actgctgtcccgtatgaggtggtggagggaggggtggcgttggcatttaggcacttgggttccttaaatcctatgctcctttctctcccggatccagttccccattcccctaccgagctgggcagttagccagcccactccaactctcggaaccatgtttgcagacttggattatgacatcgaagaggataaactgtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctg

SEQ ID NO: 170577 - DNA, 559 bp, Homo sapiens
  Payload ID: 13580
  Gene Symbol: PICK1
  Gene Name: protein interacting with PRKCA 1
  ENST ID: ENST00000435166
  CDS Start-End: 158-559
ggcactgctgtcccgtatgaggtggtggagggaggggtggcgttggcatttaggcacttgggttccttaaatcctatgctcctttctctcccggatccagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgca

SEQ ID NO: 170578 - DNA, 954 bp, Homo sapiens
  Payload ID: 13580
  Gene Symbol: PICK1
  Gene Name: protein interacting with PRKCA 1
  ENST ID: ENST00000424694
  CDS Start-End: 267-954
agaccgttcctctgttttcgcttgttcctactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagc

SEQ ID NO: 170579 - DNA, 544 bp, Homo sapiens
  Payload ID: 13580
  Gene Symbol: PICK1
  Gene Name: protein interacting with PRKCA 1
  ENST ID: ENST00000437453
  CDS Start-End: 153-544
aagtgacgtgacaatcgcggccaccgccaggtggaacggcaggtgggttcaggtaccagcctggccgggacccggctgtgggaccaacgcttccgttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattggccagcgcctcggcttccatggcccagggcctcactcttcata

SEQ ID NO: 170580 - DNA, 555 bp, Homo sapiens
  Payload ID: 13580
  Gene Symbol: PICK1
  Gene Name: protein interacting with PRKCA 1
  ENST ID: ENST00000426258
  CDS Start-End: 242-397
gacaatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaaccatgtttgcagacttggattatgacatcgaagaggataaactgtatttgacaacaccccagcagccttggacggcacagtggcagctggcgatgagatcaccggtgtcaatggcaggtcaatcaaagggaaaactaaggtggaggtggcgaagatgattcaggaggtgaagtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaag

SEQ ID NO: 170581 - DNA, 631 bp, Homo sapiens
  Payload ID: 13580
  Gene Symbol: PICK1
  Gene Name: protein interacting with PRKCA 1
  ENST ID: ENST00000445628
  CDS Start-End: 518-631
actcaattagccacctaaggagagagtagggcggggcttccaccggccgtgggatatgtggataatcatccttctgtatctttcttccatggctcctggggcagctggggaagcaagctggatgggcctggccccatgctgccggatgaggtggatgcctggctgtggctctgggagagccaacctcccccagggaacccactttacacaatagcagtggcagcagaggctggcgaggagacaagattcggactctggggagcactgatagcatttcccgagcctcagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattgga

SEQ ID NO: 170582 - DNA, 1736 bp, Homo sapiens
  Payload ID: 13581
  Gene Symbol: PKIA
  Gene Name: protein kinase (cAMP-dependent, catalytic) inhibitor alpha
  Uniprot ID: P61925
  ENST ID: ENST00000352966
  CDS Start-End: 142-372
tgctggcaggtggggcgcgggccggcgcgagctgaccgagcactcggcgggcgcggcgggactgcggcccgtggcggcgtgcgcggggacctgcgctgactaggtccggggaagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcattt

SEQ ID NO: 170583 - DNA, 4163 bp, Homo sapiens
  Payload ID: 13581
  Gene Symbol: PKIA
  Gene Name: protein kinase (cAMP-dependent, catalytic) inhibitor alpha
  Uniprot ID: P61925
  ENST ID: ENST00000396418
  CDS Start-End: 487-717
atccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacattttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcattttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgta

SEQ ID NO: 170584 - DNA, 588 bp, Homo sapiens
  Payload ID: 13581
  Gene Symbol: PKIA
  Gene Name: protein kinase (cAMP-dependent, catalytic) inhibitor alpha
  Uniprot ID: P61925
  ENST ID: ENST00000518467
  CDS Start-End: 81-311
aacttctagaatccatcgatgtggaacacttcagtttgtttaacgtaggagactccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgctta

SEQ ID NO: 170585 - DNA, 1595 bp, Homo sapiens
  Payload ID: 13582
  Gene Symbol: PKIB
  Gene Name: protein kinase (cAMP-dependent, catalytic) inhibitor beta
  Uniprot ID: Q9C010
  ENST ID: ENST00000258014
  CDS Start-End: 160-417
tatccgcacaggctctagaacttggtttcttgaagaagttgtaggaaagaaagtttatcagaattttttaaacctgtctcagaaataacaacatattttaatcagagatttgctgaagcttcagagatcacctgccaaacacaggctgaacctgacagcatgtcacaccaggatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactga

SEQ ID NO: 170586 - DNA, 1043 bp, Homo sapiens
  Payload ID: 13582
  Gene Symbol: PKIB
  Gene Name: protein kinase (cAMP-dependent, catalytic) inhibitor beta
  Uniprot ID: Q9C010
  ENST ID: ENST00000354275
  CDS Start-End: 110-346
gggttatttttagcaatctggctcacactgagggcttcctgctctattcagcaaatgtgcaaatggatgctgcaggaccgtaacagtagacattgatgaagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaa

SEQ ID NO: 170587 - DNA, 556 bp, Homo sapiens
  Payload ID: 13582
  Gene Symbol: PKIB
  Gene Name: protein kinase (cAMP-dependent, catalytic) inhibitor beta
  ENST ID: ENST00000368446
  CDS Start-End: 207-470
ggttatttttagcaatctggctcacactgagggcttcctgctctattcagcaaatgtgcaaatggatgctgcaggaccgtaacagtagacattgatgaaggttgtgatcaatgattagactctcaagcctgttgtgtttttgatctagccatgcctttcaaccactgtggtgaacatttacttctgaataggctcatcttcttcatatgcacattctatttgtagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggt

SEQ ID NO: 170588 - DNA, 1561 bp, Homo sapiens
  Payload ID: 13582
  Gene Symbol: PKIB
  Gene Name: protein kinase (cAMP-dependent, catalytic) inhibitor beta
  Uniprot ID: Q9C010
  ENST ID: ENST00000368448
  CDS Start-End: 628-864
gaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttcacctgtgccacaggccaccatggatctgcacctcgatgcccttcggagtcatgagagtgcaagcaatagcagctcaggaagcagcagcagaggagaccagaaaggtcactacctttgcatgaacaacaatggcaaccaggataccatgcttggttctccatgatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaa

SEQ ID NO: 170589 - DNA, 1398 bp, Homo sapiens
  Payload ID: 13582
  Gene Symbol: PKIB
  Gene Name: protein kinase (cAMP-dependent, catalytic) inhibitor beta
  Uniprot ID: Q9C010
  ENST ID: ENST00000368452
  CDS Start-End: 465-701
gaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaa

SEQ ID NO: 170590 - DNA, 1811 bp, Homo sapiens
  Payload ID: 13582
  Gene Symbol: PKIB
  Gene Name: protein kinase (cAMP-dependent, catalytic) inhibitor beta
  Uniprot ID: Q9C010
  ENST ID: ENST00000392490
  CDS Start-End: 398-634
gaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggaatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactg

SEQ ID NO: 170591 - DNA, 1379 bp, Homo sapiens
  Payload ID: 13582
  Gene Symbol: PKIB
  Gene Name: protein kinase (cAMP-dependent, catalytic) inhibitor beta
  Uniprot ID: Q9C010
  ENST ID: ENST00000392491
  CDS Start-End: 448-684
gtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactggtttttctttcgtttaaagatgacacactctgaaattaatttgattttgagatttgagaacttggacatacatacttcctatggaaggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccct

SEQ ID NO: 170592 - DNA, 1936 bp, Homo sapiens
  Payload ID: 13582
  Gene Symbol: PKIB
  Gene Name: protein kinase (cAMP-dependent, catalytic) inhibitor beta
  Uniprot ID: Q9C010
  ENST ID: ENST00000615438
  CDS Start-End: 502-759
gactgcgcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactggtttttctttcgtttaaagatgacacactctgaaattaatttgattttgagatttgagaacttggacatacatacttcctatggaaggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttgctgaagcttcagagatcacctgccaaacacaggctgaacctgacagcatgtcacaccaggatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactg

SEQ ID NO: 170593 - DNA, 1153 bp, Homo sapiens
  Payload ID: 13583
  Gene Symbol: PKIG
  Gene Name: protein kinase (cAMP-dependent, catalytic) inhibitor gamma
  Uniprot ID: Q9Y2B9
  ENST ID: ENST00000349959
  CDS Start-End: 250-480
aaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 170594 - DNA, 1180 bp, Homo sapiens
  Payload ID: 13583
  Gene Symbol: PKIG
  Gene Name: protein kinase (cAMP-dependent, catalytic) inhibitor gamma
  Uniprot ID: Q9Y2B9
  ENST ID: ENST00000372886
  CDS Start-End: 277-507
aacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 170595 - DNA, 769 bp, Homo sapiens
  Payload ID: 13583
  Gene Symbol: PKIG
  Gene Name: protein kinase (cAMP-dependent, catalytic) inhibitor gamma
  ENST ID: ENST00000372887
  CDS Start-End: 304-498
aggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagagatggatctcactatgttgccctggctggtctcaaactcctaggctcaagcaatcctcctgcctcgcctcccaaagtgctgggatcacaggcatgaaccaccacgcctggcccagggggattccagttccaagccttaagacccaacaaagacacacttcagaactcaggagacaccatggtccctggttcttgtgatttctcccaactatgggtgggagacaagctcacccagggccagcctctccattccttctcacaggacccacctggtaggcctggacatgtccaggcaagaggctgcttcctgggatg

SEQ ID NO: 170596 - DNA, 1489 bp, Homo sapiens
  Payload ID: 13583
  Gene Symbol: PKIG
  Gene Name: protein kinase (cAMP-dependent, catalytic) inhibitor gamma
  Uniprot ID: Q9Y2B9
  ENST ID: ENST00000372889
  CDS Start-End: 586-816
gggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccagtaagatagagactgccactctctgggaaccttgctgtgtagctgagcctcagcaagtttgataatacagacacagcaggaggcctggggaggacccagcatgcccggccaccaagcagtgatgcagctggactgttccgcagctttccagagacctccatggaagcacagacttccatgggttgaagagagtttgtgtcacaattccagtccctagccctggccctgtgtgaagtagtaacaccgccctgccagtaggatatagctgctgaggaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 170597 - DNA, 1443 bp, Homo sapiens
  Payload ID: 13583
  Gene Symbol: PKIG
  Gene Name: protein kinase (cAMP-dependent, catalytic) inhibitor gamma
  Uniprot ID: Q9Y2B9
  ENST ID: ENST00000372891
  CDS Start-End: 540-770
ccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttgtggtggtgaggaggtgatgttctggaaggaaggtacctagactttgtggtccctgccaggaagtggagagtggaaatgtggaatgcctcacactcctcaactagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 170598 - DNA, 1338 bp, Homo sapiens
  Payload ID: 13583
  Gene Symbol: PKIG
  Gene Name: protein kinase (cAMP-dependent, catalytic) inhibitor gamma
  Uniprot ID: Q9Y2B9
  ENST ID: ENST00000372892
  CDS Start-End: 435-665
ccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 170599 - DNA, 1191 bp, Homo sapiens
  Payload ID: 13583
  Gene Symbol: PKIG
  Gene Name: protein kinase (cAMP-dependent, catalytic) inhibitor gamma
  Uniprot ID: Q9Y2B9
  ENST ID: ENST00000372894
  CDS Start-End: 288-518
ccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtga

SEQ ID NO: 170600 - DNA, 4231 bp, Homo sapiens
  Payload ID: 13584
  Gene Symbol: PACSIN1
  Gene Name: protein kinase C and casein kinase substrate in neurons 1
  Uniprot ID: Q9BY11
  ENST ID: ENST00000244458
  CDS Start-End: 196-1530
agagcgacgcggtggcggcggcagcgccagccccctcctcccccgggaagtcggccgggcttgaggccgggccccagacgtcccgcttcgccccgagtcgccgccgatggtccccggagctcctgcccccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacggcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagctcctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggctg

SEQ ID NO: 170601 - DNA, 4229 bp, Homo sapiens
  Payload ID: 13584
  Gene Symbol: PACSIN1
  Gene Name: protein kinase C and casein kinase substrate in neurons 1
  ENST ID: ENST00000374043
  CDS Start-End: 322-1530
agagcgacgcggtggcggcggcagcgccagccccctcctcccccgggaagtcggccgggcttgaggccgggccccagacgtcccgcttcgccccgagtcgccgccgatggtccccggagctcctgcccccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacggcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagctcctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggc

SEQ ID NO: 170602 - DNA, 4286 bp, Homo sapiens
  Payload ID: 13584
  Gene Symbol: PACSIN1
  Gene Name: protein kinase C and casein kinase substrate in neurons 1
  Uniprot ID: Q9BY11
  ENST ID: ENST00000538621
  CDS Start-End: 261-1595
agttctggcgctgctgccttcctgagtgagcggtggagggaaccctagaggacagagcccccagcccggcagcaggccccctctccgcccgccaccacggaggagaaggaggacagccagcccctccagccctggcctggcccagcgggggcagtaagctcctacttgcccccagcttggtgcccacacgggcccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacggcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagctcctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtc

SEQ ID NO: 170603 - DNA, 4299 bp, Homo sapiens
  Payload ID: 13584
  Gene Symbol: PACSIN1
  Gene Name: protein kinase C and casein kinase substrate in neurons 1
  Uniprot ID: Q9BY11
  ENST ID: ENST00000620693
  CDS Start-End: 274-1608
gcacgcctcctcctcatccttcccccctctccgcctcagctctgaccttcctccttcccgcagccccggcgagatcccagagcgacgcggtggcggcggcagcgccagccccctcctcccccgggaagtcggccgggcttgaggccgggccccagacgtcccgcttcgccccgagtcgccgccgatggtccccggagctcctgcccccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacggcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagctcctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtc

SEQ ID NO: 170604 - DNA, 3249 bp, Homo sapiens
  Payload ID: 13585
  Gene Symbol: PACSIN2
  Gene Name: protein kinase C and casein kinase substrate in neurons 2
  Uniprot ID: Q9UNF0
  ENST ID: ENST00000263246
  CDS Start-End: 203-1663
gcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgcata

SEQ ID NO: 170605 - DNA, 3149 bp, Homo sapiens
  Payload ID: 13585
  Gene Symbol: PACSIN2
  Gene Name: protein kinase C and casein kinase substrate in neurons 2
  Uniprot ID: Q9UNF0
  ENST ID: ENST00000337959
  CDS Start-End: 223-1560
ctgtcccactgggcaggtgcctctgacggagaggaggcgtcgtcgggaagtatgtggccgtggctgctctggcatgatcctgaagactggcacgaaggggaatggagccgcacagagaatttcaggcatcagaggggaagcgcaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagtgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgcatatgg

SEQ ID NO: 170606 - DNA, 1883 bp, Homo sapiens
  Payload ID: 13585
  Gene Symbol: PACSIN2
  Gene Name: protein kinase C and casein kinase substrate in neurons 2
  Uniprot ID: Q9UNF0
  ENST ID: ENST00000402229
  CDS Start-End: 194-1654
ggtcagacatgccagcagggttggaaagaggcaggtacggaagctgagctgcagagttagccggcatctgacagaaaaatgtgagtgtgctgtggaaggcttgcatttcctttaaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagcc

SEQ ID NO: 170607 - DNA, 2110 bp, Homo sapiens
  Payload ID: 13585
  Gene Symbol: PACSIN2
  Gene Name: protein kinase C and casein kinase substrate in neurons 2
  Uniprot ID: Q9UNF0
  ENST ID: ENST00000403744
  CDS Start-End: 223-1683
ctgtcccactgggcaggtgcctctgacggagaggaggcgtcgtcgggaagtatgtggccgtggctgctctggcatgatcctgaagactggcacgaaggggaatggagccgcacagagaatttcaggcatcagaggggaagcgcaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaa

SEQ ID NO: 170608 - DNA, 3080 bp, Homo sapiens
  Payload ID: 13585
  Gene Symbol: PACSIN2
  Gene Name: protein kinase C and casein kinase substrate in neurons 2
  Uniprot ID: Q9UNF0
  ENST ID: ENST00000407585
  CDS Start-End: 161-1498
agaggtcagacatgccagcagggttggaaagaggcaggtacggaagctgagctgcagagttagccggcatctgacagaaaaatgtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagtgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtg

SEQ ID NO: 170609 - DNA, 622 bp, Homo sapiens
  Payload ID: 13585
  Gene Symbol: PACSIN2
  Gene Name: protein kinase C and casein kinase substrate in neurons 2
  ENST ID: ENST00000418133
  CDS Start-End: 167-622
ctttccagaagacattccaaccaccatggtagagtcacagtaatgtcatggagaatgaagggagtcggggactaaacaagtggctgcaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggta

SEQ ID NO: 170610 - DNA, 818 bp, Homo sapiens
  Payload ID: 13585
  Gene Symbol: PACSIN2
  Gene Name: protein kinase C and casein kinase substrate in neurons 2
  ENST ID: ENST00000453643
  CDS Start-End: 354-818
gggtctgggcagggctgggcagtgctgccggagcaaaagcggtagcgggagcccggccggagctgggtctggagacgccgtggcagcctgaacggagtgtgcgacggattgggaggaggaactgccaggtcggatgtggagatgaacccggagagtgtccttcggctctggtcggccttcaggggcattcctgccagtctcagaagatgacagtctgcaatcgtgttatcatcaacgtggaaaaaataagggcaatgcagttttcatgtgtgtaaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtacatctgtcc

SEQ ID NO: 170611 - DNA, 505 bp, Homo sapiens
  Payload ID: 13585
  Gene Symbol: PACSIN2
  Gene Name: protein kinase C and casein kinase substrate in neurons 2
  ENST ID: ENST00000453079
  CDS Start-End: 406-505
agaattcagctgagagacagaggtcagacatgccagcagggttggaaagaggcaggtacggaagctgagctgcagagttagccggcatctgacagaaaaatgtgagtgtgctgtggaaggcttgcatttcctttaaggtagacctctttgaaagtagaattttcacggaattgttttctttctcactgagtgactgatttaacagaactctcaccttctatgcaagcgcacctagttttagagctccgtgacggcaatgttcaattagttcattattaactgagcaatgcagaatgctttatccagggtgcttggagaagatgtcagagtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatg

SEQ ID NO: 170612 - DNA, 664 bp, Homo sapiens
  Payload ID: 13585
  Gene Symbol: PACSIN2
  Gene Name: protein kinase C and casein kinase substrate in neurons 2
  ENST ID: ENST00000422336
  CDS Start-End: 209-664
actttgatgagcaaggaacgctgttttagaaaatccttactacttgatgattaatccttggagctaatgttccacgttcccaaggttgtgagtgcttatggccacattcctgcatcagctcagccatcgcggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggta

SEQ ID NO: 170613 - DNA, 362 bp, Homo sapiens
  Payload ID: 13585
  Gene Symbol: PACSIN2
  Gene Name: protein kinase C and casein kinase substrate in neurons 2
  ENST ID: ENST00000507586
  CDS Start-End: 1-178
gacggaagtgcgagtccgggccctgtatgactatgaggggcaggagcatgatgagctgagcttcaaggctgagacggggtttcaccatattatccagtctggtcttgaactcctgagctcaagtgatcctcccgcctcagcctcccaaagtgctgggatcacaggcatgagcccctgagactgcaaataaaccatgctttagagaagatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctataggg

SEQ ID NO: 170614 - DNA, 1431 bp, Homo sapiens
  Payload ID: 13585
  Gene Symbol: PACSIN2
  Gene Name: protein kinase C and casein kinase substrate in neurons 2
  ENST ID: ENST00000634914
  CDS Start-End: 78-1431
gtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggatgaagagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctg

SEQ ID NO: 170615 - DNA, 1843 bp, Homo sapiens
  Payload ID: 13586
  Gene Symbol: PACSIN3
  Gene Name: protein kinase C and casein kinase substrate in neurons 3
  Uniprot ID: Q9UKS6
  ENST ID: ENST00000298838
  CDS Start-End: 163-1437
aggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaaca

SEQ ID NO: 170616 - DNA, 554 bp, Homo sapiens
  Payload ID: 13586
  Gene Symbol: PACSIN3
  Gene Name: protein kinase C and casein kinase substrate in neurons 3
  ENST ID: ENST00000524509
  CDS Start-End: 347-554
agcggcaggactcgggccggagcgtggccggacccccacccgccgaggggcccagggaggacgcgcgcgtggggacacacaaatcagaatcctggaagcctctgtcggtgactgaagatagacactgtcctgtcagccacaactccatgggttatacaccccggctgaagggtcacccggggctacaggagcaaggacagagaaacaggggaagtgactgaggagaagatgccttaattggaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggaga

SEQ ID NO: 170617 - DNA, 912 bp, Homo sapiens
  Payload ID: 13586
  Gene Symbol: PACSIN3
  Gene Name: protein kinase C and casein kinase substrate in neurons 3
  ENST ID: ENST00000530513
  CDS Start-End: 768-912
cgctccgggaggccgcggcgcgggcccaggagcggcaggactcgggccggagcgtggccggacccccacccgccgaggggcccagggaggacgcggcagagtcacggtggcagcattgagagttggacacccgggtccttgaagtgatctctaggccccaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgc

SEQ ID NO: 170618 - DNA, 1845 bp, Homo sapiens
  Payload ID: 13586
  Gene Symbol: PACSIN3
  Gene Name: protein kinase C and casein kinase substrate in neurons 3
  ENST ID: ENST00000532457
  CDS Start-End: 196-1158
tccgggaggccgcggcgcgggcccaggagcggcaggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggcattggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaac

SEQ ID NO: 170619 - DNA, 443 bp, Homo sapiens
  Payload ID: 13586
  Gene Symbol: PACSIN3
  Gene Name: protein kinase C and casein kinase substrate in neurons 3
  ENST ID: ENST00000533686
  CDS Start-End: 1-229
agaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccagggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgaggga

SEQ ID NO: 170620 - DNA, 864 bp, Homo sapiens
  Payload ID: 13586
  Gene Symbol: PACSIN3
  Gene Name: protein kinase C and casein kinase substrate in neurons 3
  ENST ID: ENST00000528201
  CDS Start-End: 757-864
ggaggccgcggcgcgggcccaggagcggcaggactcgggccggagcgtggccggacccccacccgccgaggggcccagggaggacgcgagtcacggtggcagcattgagagttggacacccgggtccttgaagtgatctctaggccccaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttcc

SEQ ID NO: 170621 - DNA, 654 bp, Homo sapiens
  Payload ID: 13586
  Gene Symbol: PACSIN3
  Gene Name: protein kinase C and casein kinase substrate in neurons 3
  ENST ID: ENST00000531226
  CDS Start-End: 210-654
gcaggactcgggccggagcgtggccggacccccacccgccgaggggcccagggaggacgcggcagagtcacggtggcagcattgagagttggacacccgggtccttgaagtgatctctaggccccagaaacataatgtccagctttcctgcttacccctctgccctccacagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaagg

SEQ ID NO: 170622 - DNA, 683 bp, Homo sapiens
  Payload ID: 13586
  Gene Symbol: PACSIN3
  Gene Name: protein kinase C and casein kinase substrate in neurons 3
  ENST ID: ENST00000525725
  CDS Start-End: 258-683
aggggctgcccgggaaagaagcccttgggcgcagcctgtgactcaggttccagggatgggccaggcagaatggctgagctccctcccaggggcaagcccccagcttctggaagaggttggggctggtctggggccgggtaccttcaggcctcaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccc

SEQ ID NO: 170623 - DNA, 563 bp, Homo sapiens
  Payload ID: 13586
  Gene Symbol: PACSIN3
  Gene Name: protein kinase C and casein kinase substrate in neurons 3
  ENST ID: ENST00000530405
  CDS Start-End: 356-563
gtcactcaagggaaggcaacagaggccctagcctgggcaggagtcctctcatcggcagttgggggagtggggccttctgcccaccgcccacccccgcctgccatttaatccctggctggatcgtgtgacctgcctggcattctcctccctggaatccggcgcttctgacagcagttgctatattgggggtgccgggcaccgccctggacgctctaggcccccaccctcacccccgctctgttctccttcaaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggaga

SEQ ID NO: 170624 - DNA, 1560 bp, Homo sapiens
  Payload ID: 13586
  Gene Symbol: PACSIN3
  Gene Name: protein kinase C and casein kinase substrate in neurons 3
  ENST ID: ENST00000528462
  CDS Start-End: 344-1560
aagaccaagttcaacaagtttggccaagaagtctagagcttcggtggctaggcctggccctgccgctccgcgtggctccacgggctccgagttatgcagctccgggcggcaaggggtcctgtcgaggggcgcggtccataagggttgaggccagaggcgcgtagcctctgggcgccgagctctggagtggaggctggggttcggagtgcgtcatctggaagcaggcaccccggccggcaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagtt

SEQ ID NO: 170625 - DNA, 2009 bp, Homo sapiens
  Payload ID: 13586
  Gene Symbol: PACSIN3
  Gene Name: protein kinase C and casein kinase substrate in neurons 3
  Uniprot ID: Q9UKS6
  ENST ID: ENST00000539589
  CDS Start-End: 344-1618
aagaccaagttcaacaagtttggccaagaagtctagagcttcggtggctaggcctggccctgccgctccgcgtggctccacgggctccgagttatgcagctccgggcggcaaggggtcctgtcgaggggcgcggtccataagggttgaggccagaggcgcgtagcctctgggcgccgagctctggagtggaggctggggttcggagtgcgtcatctggaagcaggcaccccggccggcaggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggcccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacac

SEQ ID NO: 170626 - DNA, 569 bp, Homo sapiens
  Payload ID: 13587
  Gene Symbol: PRKCSH
  Gene Name: protein kinase C substrate 80K-H
  ENST ID: ENST00000591946
  CDS Start-End: 384-569
aactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctct

SEQ ID NO: 170627 - DNA, 578 bp, Homo sapiens
  Payload ID: 13587
  Gene Symbol: PRKCSH
  Gene Name: protein kinase C substrate 80K-H
  ENST ID: ENST00000593101
  CDS Start-End: 147-578
agtttcttacagggggcaaccggagggtgcatgtgtgggtgtggacggcggaggctgttaatccctttgcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatcctt

SEQ ID NO: 170628 - DNA, 1898 bp, Homo sapiens
  Payload ID: 13587
  Gene Symbol: PRKCSH
  Gene Name: protein kinase C substrate 80K-H
  Uniprot ID: P14314
  ENST ID: ENST00000589838
  CDS Start-End: 1-1587
atgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctca

SEQ ID NO: 170629 - DNA, 2209 bp, Homo sapiens
  Payload ID: 13587
  Gene Symbol: PRKCSH
  Gene Name: protein kinase C substrate 80K-H
  Uniprot ID: P14314
  ENST ID: ENST00000591462
  CDS Start-End: 296-1873
agagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccaccc

SEQ ID NO: 170630 - DNA, 545 bp, Homo sapiens
  Payload ID: 13587
  Gene Symbol: PRKCSH
  Gene Name: protein kinase C substrate 80K-H
  ENST ID: ENST00000587509
  CDS Start-End: 124-545
tccgctttctttctgcagcaggaaccgcggctgctggacaagagggcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaa

SEQ ID NO: 170631 - DNA, 557 bp, Homo sapiens
  Payload ID: 13587
  Gene Symbol: PRKCSH
  Gene Name: protein kinase C substrate 80K-H
  ENST ID: ENST00000588269
  CDS Start-End: 161-557
atttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccagtgagtcctcctgttcaccctcccgccaggctggaggtgggaggggccaacattgggccttagggataggcatttacagccttttgactcagtttcccggtagtgctccgctggtggggatgggaggacagaggtggtatttggtggagaaggcgcttacctgccctgggctgagcttcctgtaccccgcagatcatcacttctacgatgagtccaagcctttcacctgcctggacggttcggccaccatcccatttgatcaggtcaacgatgactattgcgactgcaaagatggctctgacgagccaggcacggctg

SEQ ID NO: 170632 - DNA, 1613 bp, Homo sapiens
  Payload ID: 13587
  Gene Symbol: PRKCSH
  Gene Name: protein kinase C substrate 80K-H
  ENST ID: ENST00000586486
  CDS Start-End: 1-603
gctgaagaagaggaggaggaggaggattccgaggtgcagggggagcagcccaagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagaggtgggcggggaggtggagtctcgtcggcctgccccagcaaggggaggcggcgggccctgaggaagatggacccacatggccactctatcaacctgtgtccccatgttccctgcttttttgttttgtttttttgaggtggagtctcactctttggcccaggctggagtgcagtgatgcgacctcagctgactgcaacctctacctcccgggttcaaacaattgtcttgtctcagcctcccaagtagctgggattacaggtgtgcaccaccatgcctggctaatttttagtagagatggggtttcaccatgttggcctggatggtctcgaactcctgacctcagatgatccacctgccttggcctcccaaagtgctgggattacaggcatgagccaccacacccggccatctcctgcctttttttttttggatggagtttcactcttgttgccgagatcatgctactgcactctccagcctgggctacagagtgagactctcaaaaaaaaaaaataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 170633 - DNA, 2189 bp, Homo sapiens
  Payload ID: 13587
  Gene Symbol: PRKCSH
  Gene Name: protein kinase C substrate 80K-H
  Uniprot ID: P14314
  ENST ID: ENST00000587327
  CDS Start-End: 374-1951
cttacagggggcaaccggagggtgcatgtgtgggtgtggacggcggaggctgttaatccctttggtctgttggcgggaattgggtcacaattgggcacagggagcggaggttttgagatcttgagatcctcgccattgatttgagcaaagtgagactggccaggattggggagatcgctgcccctcgcccccatatcggaaacaaagtgaggcctcattgcctggaagcgatggaggaatccaattggctggaagtagccctctcccactgaccgggatccgctttcttcctgcagcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcg

SEQ ID NO: 170634 - DNA, 2100 bp, Homo sapiens
  Payload ID: 13587
  Gene Symbol: PRKCSH
  Gene Name: protein kinase C substrate 80K-H
  ENST ID: ENST00000592741
  CDS Start-End: 154-1761
ctttctgcagcaggaaccgcggctgctggacaagaggggtgcggtggatactgacctttgctccggcctcgtgtagcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 170635 - DNA, 625 bp, Homo sapiens
  Payload ID: 13587
  Gene Symbol: PRKCSH
  Gene Name: protein kinase C substrate 80K-H
  ENST ID: ENST00000589126
  CDS Start-End: 121-625
cagaaatttccgctttctttctgcagcaggaaccgcggctgctggacaagaggggtgcggtggatactgacctttgctccggcctcgtaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctc

SEQ ID NO: 170636 - DNA, 2718 bp, Homo sapiens
  Payload ID: 13588
  Gene Symbol: PRKCA
  Gene Name: protein kinase C, alpha
  ENST ID: ENST00000284384
  CDS Start-End: 1-451
cgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatctcttctcccctgtattgctagtctgcctctaccttttgagatcctactcactctccgaaggaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcaggtaatgttttgctacattttcatgtttgtttattgctgtgttatgtgaatacttcagctctggttgggcctcgagagcaagacctgacgttttagtgcagctggtgttggcgtgacttccctgacccaggcgaaagagggagaaacgcccccttcaaagtggatcacgttcagtatgcacagaaattatctctggtcatagaaactccaaattgaaagctacaacctggagtgtagacagtgtcagtttcacgttatgaaatgtacatgttggccaggcgcggtggctcatggctataatcccagcactttcagaagccaaggcaggcggatcgcctgaggtcaggagttcgagaccaccctggccaacatggcgaaaccccatctctactaaaaatacaaaaattagccaggcgtggtggtgcacatctgtaaactcagctacttgagctactgaggcatgagaattgcttaagcctgagaggcggaggctgcagtgagccaagatcgtgccactgcactgcagcctgggcaacagagtgagacggtctcaaaaaagaaaaaaatgtgcacgttgatgacagcagtggcctctaagttttcagtatcttaaaactggggttgggttatatggttccctgcaagtttgtctgcaaagattgccccagctgctgccaatgtgtgtaattagtattattatttaaggaagaagacagttaccttgaagaagtgttttaatagtttctccccatctcctcctatctcacccttggcaattcgttgtaattttcactgaagtccagtgaggctgaacatccagttaaggaaggtaaattagctttctcttatgatgtgacatgtaccagataaccatgtgccttattgcctaacatggcactttctaatataatggccttaatatctgtgtcatcagggtgaatcgtactatctgccacttctaggcctggcccctaagacatcctttatgactgtcctcatgctctaggctgaaattaggaggaattagtggagaaatctgagaccctacaagatggtggtgc

SEQ ID NO: 170637 - DNA, 8751 bp, Homo sapiens
  Payload ID: 13588
  Gene Symbol: PRKCA
  Gene Name: protein kinase C, alpha
  Uniprot ID: P17252
  ENST ID: ENST00000413366
  CDS Start-End: 27-2045
gaggcaagaggtggttgggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctgtctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtgggaagtgaatccttaaccctaaaattttaaggccacggccttgtgtctgattccatatggaggcctgaaaattgtagggttattagtccaaatgtgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcaccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaatagaaggattttaatacgttttgcaaatgcatcatgcaatgaattttgcatgtttataataaaccttaataacaagtgaatctatattattgatataatcgtatcaagtataaagagagtattataataattttataagacacaattgtgctctatttgtgcaggttcttgtttctaatcctcttttctaattaagttttagctgaatcccttgcttctgtgctttccctccctgcacatgggcactgtatcagatagattactttttaaatgtagataaaatttcaaaaatgaatggctagtttacgtgatagattaggctcttactacatatgtgtgtgtatatatatgtatttgattctacctgcaaacaaatttttattggtgaggactatttttgagctgacactccctcttagtttcttcatgtcacctttcgtcctggttcctccgccactcttcctcttggggacaacaggaagtgtctgattccagtctgcctagtacgttggtacacacgtggcattgccgcagcacctgggctgacctttgtgtgtgcgtgtgtgtgtgtttccttcttcccttcagcctgtgactgttgctgactccaggggtgggagggatggggagactcccctcttgctgtgtgtactggacacgcaggaagcatgctgtcttgctgcctctgcaacgacctgtcgtttgctccagcatgcacaaacttcgtgagaccaacacagccgtgccctgcaggcaccagcacgtgcttttcagaggctgcggactttcttccagccattgtggcattggcctttccagtcttgggaggagcgcgctgctttggtgagacacccccatgcaaggtcctcagagtagccgggttctaccacaaacagaaacagaatgaaagtagctgtcagtccttgtagagagccgctctgtttcctcccagaagcatctcccagctaagctcgcattatttttctcctctggctgtttgcctgaagttcacagaacacacaaccatgaaaggctttttgaggtgagaggcccaggtggtcctggcaaccctgagtagaaggagagacggggtagggaacgggcccggccagaaaagaaccatttcttctgccatcttttatgcaccatagacatcgagactccagggggtcctggctcccctgtccctgcagccctgcaggtcagtgcatgatctgggttcgtgtcctgaccaggtgctcctcctttgatccgaggggaaagggactggtttatagaaagagcctaggagacaaaagggccagtccccctgcccagaatggagcagcagcaggacagacccccacgaggccccccagagaggaggaagatcccacggaggaacacatgaggttagggacccttgttcagcaccccaaacagcctgcctgtttaaagcaggcagcaggcttaggccttccctgcaaccccaacacccacaagtttgtttctctaggaaacacattcactgtctcagctggctgttactctctcagaccatatggcaaagttttccaagaaaatgccccgacaggggtgcccagcacactgcctgagggacaacagacatcagaacaaacccccagagagaaacagtcaaaatcagggcccggtgcagtgttgtcatgtggaacctgctttatccattgctgagtgttgaatgtgggtaatggttagggctttccagatctcagcagccaaagacagttattgttggaagactgtcatgtagataaccatgagcaatggctcgcctcagaatcagttcataaaattctatggtactggccccttcgtgggtattgtgtgaaatgagatggtggcgaggggtgcgctgtggaactgccgcagccacgcaggaggtccctgggggatgctttgggaagtccttgcccctgagcactgcctgattgccagggcctgtggaggtctaggccgcctggcagaatctagcaccgtccgaatccccgcaggacccatggagctatgaccacaccaggccattcaaatggctctgcattatcttcccttggaaggtggccactcctcggtggcagggcctttccctgaggctgcaggccgtgggctggcagcccgtctcttggcatttcaattgaaggtcaccaggtgctgggtttgaaaggaagtcactggagtgctgccaggggccgccctccaaggttaatgagaggcccacatccaggcaagaactaattcaaaaggcagatcagaaaccacaggagtcaaaattattgctccggcagtgcttcccttcctttcatccactggcctcgtgtggtccatgcagggccactgtctgccctttctgatgccacgtattaggctttcttactcagaattttgatagaaaaccatggggccaagagctctggaagcctggccggaaagaccaaggttcatgcagcccaacaaatgattgttgagcacctctcggagccaaagtccttaggcgagtgtggtgacttcctggaaggaggatgcagacttccagagagcccccccaacggacgtgctgagaagggagagggaggcgggggctgtagtcaggaaggagccagagaagaacagggtttgggtgcatccagaaatatgcctgcagtaggagggagaggaaggggtgccaccgtcaacggcttcccatcggaggtggttggtgcagatggaagtttctgtctgctggccctcaagagagtgttttgccagggacacagtctgttcctcctcagaaaacaccccccaaatgctaacaacatccccaccagctgctagaagcccctttcccctccccaccttgaagtagctcatagttctctgggcagagccagaccatccagtgtaccccagaggccagtaggttcctgcccattttcctctctggcttcctgccaagaattatggcagctgaggatgaatggagaagtaaaaacaactaacaccgcacaactaacaactaacaccgcagttcccacctgggttccacttagcaggagacatttcggagggttttttttgtttttgttcctgttttttttttttttgctggaatttgttttctcagtactgaaaagagaaaaagtgacaatcttgtatttttaaaagcctcggaaaggtgataccatctgacagtcattttctcacgttggtcttctaaagtcacctatttcttgtgtgtgcacatcacaccatttcctgtttctttataacccgacaagggtaggagtgcctgtttcccctgctgggcacaccagacaatcgtaatcacaaaacagacactgagccaggggcccaaagggtgtgatcatgagagttaccgggacagcagtaggcatgacagtcaccaggaaggacaagggtgctctgttgttagtggccacacaccaatttgacaaggagtgttgcgaaatttttatttatttatttatttattttgagatggagtttcactcttgttgcccaggctggagtgcggtggtacaatctcggctcactgcaacctccacctcccaggttcaagcgattctcctgcctcagcctcccaagtacctgggactacaggtgcgtgccaccacacccagctaaattttgtgtttttagtagagatggggtttcaccatgttggccaggatggtcttgaacccctgacctcatgatctgcctgcctcggcctcccaaagtgctgggattacaggcatgagccaccacgcccagccaaaatatttttttaaagtcattttccttaagctgcttgggctacatgtgaaatacactggacggtcaacattcctgtctcctcccatttgggctgatgcagcagatccagggaatgttacctgtttctgctgctagaagatccaggaaattgggaaggttacctgacgcacacatggatgaaggccatcatctagaaatggggtcaaccacaattgtgttaattccgtagtgtcagggattcttcgggaaggtcaacagtatgaaggattctgacccctgtgcctcccatttatgtgatcaggtgacagttaataaccgtggaggtcacactcagccatccaacagccttacagtgaccctacacaaaagcccccaaattccaaagactttttcttaacctaaaggaagaaattatttgttaattccagtagagcaactgaatatactgggctatttgtacttttttatagagaactttaataataattctttaaaaatgagtttttagaacaaagcaactgacgatttcctaagattccaatgccctggagcttgtaggaggacttagcctgggtcagctggagcacccccgacctgatctcccactgccagattttcccatgctcctagggtatggagtccacgtgggaatgactgcaagttcaggtggaacttggccgactgatgctctgcgagtttttaatagacactggggacaactgcttaaggtttagaaacttccaaaccacaggaaagacatttttagtgtcccccatccagaggcagccctggaataggattcccaggggtttctgggacccctttccttgctccgtgaggctctgtggccatcttttggcaggaggaggatgcttccttggctctgtgcccagacccgcctggtccccaggtctctcaccttgggtgaagattcagagatgccctgtaaggattttgcccactgggcaactcagaaatacttcgatctcccaagatataagaggcagcagcaaacgtgcctattgacgtctgtttcatagttaccacttacgcgagtagacagaactcggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacctactgacaaaatgtagaggccattcaaccgtcaaacaccatttggttatatcgcagaggagacggatgtgtaaattactgcattgctttttttttcagtttgtataacctctaatctccgtttgcatgatacgctttgttagaaacattaattgtagtttggaagcaagtgtgtatgaataaagataatgatcattc

SEQ ID NO: 170638 - DNA, 1733 bp, Homo sapiens
  Payload ID: 13588
  Gene Symbol: PRKCA
  Gene Name: protein kinase C, alpha
  ENST ID: ENST00000578063
  CDS Start-End: 217-1143
gcgagccagcggctccggctcccgctcccgctccgcgcagcaccagcccgactctccccggcccccgccgcgccccctcgccgcgacctcggccaccggcccgcgccccgcgcccggggtcgccccgagcccgcacctctcccccgccgcccccgcccacccggccctccgcggccgcagctccccggcggaggcaagaggtggttgggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagtggagatgataatagagactgccgcataggactgctgggaggattcactcagttcacttacgtcaggatcatccatatggctgtccctcacctctgcatcttgtcccactggaaggtcttcaggggcagtaatacacatggagctgtcatcacccctgataacaatgccttctggaatacctcctgaaggctctgcctaaggctgttctacagttaacttttgttttaataagtagaaaaaaataagacctgatgtggtggctcatgcctataatcccagcaagtttgccaggccaaggcgggtggatcacctgaggttaggagttcaagaccagctgggccaacatagtgaaaccgcatctctactaaaaatacaaaaattagccaggcatggtggtgagagcttgtaatcccagctacttgggaggctgaggcagtagaatcacttgaacccaggaggtggaggttgcagtgagctgagatcgtgccattgcattccagcctgggtgacagaccgagactccatctcaagaaaaaaaaaaatagaaaaaatatactcttaagataacaataaaaatatagtatagtgaatacataaa

SEQ ID NO: 170639 - DNA, 7969 bp, Homo sapiens
  Payload ID: 13589
  Gene Symbol: PRKCB
  Gene Name: protein kinase C, beta
  Uniprot ID: P05771
  ENST ID: ENST00000303531
  CDS Start-End: 153-2174
gcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 170640 - DNA, 2689 bp, Homo sapiens
  Payload ID: 13589
  Gene Symbol: PRKCB
  Gene Name: protein kinase C, beta
  Uniprot ID: P05771
  ENST ID: ENST00000321728
  CDS Start-End: 176-2191
gggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 170641 - DNA, 480 bp, Homo sapiens
  Payload ID: 13589
  Gene Symbol: PRKCB
  Gene Name: protein kinase C, beta
  ENST ID: ENST00000498058
  CDS Start-End: 95-268
gcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctgaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccaca

SEQ ID NO: 170642 - DNA, 556 bp, Homo sapiens
  Payload ID: 13589
  Gene Symbol: PRKCB
  Gene Name: protein kinase C, beta
  ENST ID: ENST00000472066
  CDS Start-End: 166-556
ttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccg

SEQ ID NO: 170643 - DNA, 536 bp, Homo sapiens
  Payload ID: 13589
  Gene Symbol: PRKCB
  Gene Name: protein kinase C, beta
  ENST ID: ENST00000466124
  CDS Start-End: 1-367
gtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctctt

SEQ ID NO: 170644 - DNA, 569 bp, Homo sapiens
  Payload ID: 13589
  Gene Symbol: PRKCB
  Gene Name: protein kinase C, beta
  ENST ID: ENST00000498739
  CDS Start-End: 211-569
acaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatt

SEQ ID NO: 170645 - DNA, 2680 bp, Homo sapiens
  Payload ID: 13590
  Gene Symbol: PRKCD
  Gene Name: protein kinase C, delta
  Uniprot ID: Q05655
  ENST ID: ENST00000330452
  CDS Start-End: 362-2392
ccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataa

SEQ ID NO: 170646 - DNA, 2810 bp, Homo sapiens
  Payload ID: 13590
  Gene Symbol: PRKCD
  Gene Name: protein kinase C, delta
  Uniprot ID: Q05655
  ENST ID: ENST00000394729
  CDS Start-End: 329-2359
ggcctggcagggcgaggcctggcgggggcggggcctggcgggggcggggccggcggcacctgggtgaggtcgctcggccccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtaccaa

SEQ ID NO: 170647 - DNA, 562 bp, Homo sapiens
  Payload ID: 13590
  Gene Symbol: PRKCD
  Gene Name: protein kinase C, delta
  ENST ID: ENST00000487897
  CDS Start-End: 187-562
aaactgagaaactgagccgcggtcagcgaaagtcccgccgcgccgagacctgccggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtgg

SEQ ID NO: 170648 - DNA, 777 bp, Homo sapiens
  Payload ID: 13590
  Gene Symbol: PRKCD
  Gene Name: protein kinase C, delta
  ENST ID: ENST00000464818
  CDS Start-End: 107-777
ggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcactgcggcatgaatgtgcaccataaatgccgggagaaggtggccaacctctgcggcatcaaccagaagcttttggctgaggccttgaaccaagtcaccca

SEQ ID NO: 170649 - DNA, 589 bp, Homo sapiens
  Payload ID: 13590
  Gene Symbol: PRKCD
  Gene Name: protein kinase C, delta
  ENST ID: ENST00000478843
  CDS Start-End: 357-589
aaggattagggagtcctgagccccaggctgctctgctcagtcttggaaggcctcacgcaacccccttcacaaagcctgcccgattgtgtcctcaagggacaatttatagcatgcaatgacagtgcggagggcaggtctgtctggggagatgaaacgacctgtgcgattacaggagattcctactttcctcgcccccagtcctcaaggtcttctcagaggttcccactaggaggccggctgcagtgccctggacgaccctcacacccaggacctcagttgctccatccaaggaatgggcgagctcaggtcttcctgactttcctggagaacaaagaggccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcaga

SEQ ID NO: 170650 - DNA, 1174 bp, Homo sapiens
  Payload ID: 13591
  Gene Symbol: PRKCDBP
  Gene Name: protein kinase C, delta binding protein
  Uniprot ID: Q969G5
  ENST ID: ENST00000303927
  CDS Start-End: 172-957
aagagaccccgctgccaacatccccacgccctcgcgccctcccgccgccccagaaggccaactccgcctgcctgagtcacagctggagctggggaggagccagggaaaggaggcccctgaccgtagtgcggccagcagttgcaggcagacggagcagagcggtcagggatcatgagggagagtgcgttggagcgggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggaggagggtgaagtcccagccagcgctttccagaaggcaccagagcccttgggcccggcggaccagtccgagctgggcccagagcagctggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgctgaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccgaa

SEQ ID NO: 170651 - DNA, 957 bp, Homo sapiens
  Payload ID: 13591
  Gene Symbol: PRKCDBP
  Gene Name: protein kinase C, delta binding protein
  ENST ID: ENST00000530979
  CDS Start-End: 57-938
cctgaccgtagtgcggccagcagttgcaggcagacggagcagagcggtcagggatcatgagggagagtgcgttggagcgggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggcctcacctactttacagcgttttgcagttcgcacgcagctttccctccccttaccttcccacgcctgcctttccccccagactctggctgcggaggaggagggtgaagtcccagccagcgctttccagaaggcaccagagcccttgggcccggcggaccagtccgagctgggcccagagcagctggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgctgaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcct

SEQ ID NO: 170652 - DNA, 5650 bp, Homo sapiens
  Payload ID: 13592
  Gene Symbol: PRKCE
  Gene Name: protein kinase C, epsilon
  Uniprot ID: Q02156
  ENST ID: ENST00000306156
  CDS Start-End: 328-2541
cagcccccgcggcttgcagcggagccgacagctcgtcttctcttctggaggtgcagctggtggtcggggggagagacttgctccaaacacggacatcccccagctctcccccctccctgttttccgttaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaaggtggatgctgtcaatgcccgagtgacacatgagagctgtatgaattgagagaaaaggcaacaagtagcattcttcatcattcaagttctacctggacacaaaggcgaggaccctggggttccaacaaagctcagctcccagattctctttccagtttcatcctaagttcctagcataaacactatttattttctgcagcagtgtgttatttttgcgcacttatacaaaatggtagtactactgtgttgtggtttttaaacattaaacatgtaaagttatatacgaaatatctgcttttggaataagcagaatgaggctaaacatgggttatacaaagggtatctggaaactgaagagcaacttgttagaaaactgacaatgtcgcaagatgtactcagttttgtttctgtgtgacatgcaatggcaactcatgtggacactattgaagggatgtgacattacctcctgtagatatgctaacagtgttattctttcatttccaagggttctctgtggctttgtgtatatgtttcccagaggtcatttgattacctaatttactgaactgatttagcagggaatggaatccattccaactattgcacgtggatttcccagctgcccctaaatatatatacttgtgagtggcaaagtggcactaatgaagcttttgccttttgtacatttgagatttttgtatatagtgtttgctgcaaggcctgtggaattaattcgttgcatatagaggtatcaactgctgcatgttcaggcatattataaaactttagtctatgaaagaataattataataatgtccaggtgcaatactctgtaagtctattggttcaagttaccgagagataggtgtgttcctttatgggggatgggggggtgtgttggggattctttgtattgtttatttcattttggtttattttaaaagatgtaaacatatattaagctatattaaatctcacatacagttcttctgtgctctattataccctgatagagatgggggagagaaaggaatgtttttgatggtggtttcaaagctcggacagtaactatcttgagcccattagagagtctgtgtccatatttgcatctggctggtcatagcctttgttactaatgatgacattcagttctcttttgtttttattttttaaaaactcaggtgtaattattatctgttcttaagataattgcaaatattaaatattatgatatatcaattcatgtgtttggcataccagtgaatgatgaagaacatgagattaatttaatttatcttcggtaacttgacattctggagagagactatcttctggagttgagtacaagcacagaaacatctttacggtggcatcatctcattttttaggaagacatgataatactgcccatcatattcatgtgtaactactgttctttcttctgctttcttcaccataataaactttggacaaccaagcaagctctaaccgcaatgccagatggccttgtccgagggcctagtgtttgcacggcagtgggaactgggcctttcctacaggacaactggcaagtttgctgggaagtcaaataatacattccacctggcagctgaaggcagccagtcagtctgtcccagaaagggcccttttcagcacccaaagctgggctggctgggatgcctctggctggtgaagttctcacataggctgatttaaatccagcaaaggtctatagaaaaaggcttgcgtgttcgttgagtaatcattgtttcattttcatttttacgagagtttgaaaatagacacactgttaacacttctgccagttttttctgatctttccagccccaccccctttctctttctctctctctctcaaagaaaaaaaaaatgggagtgcaaaaaaaacaaagccaaaaaatatatgaaggatagctgttcttctgtgttctctcattatggactttgtgaagtagaaacataattttttttcctccaaaggtgaaaaaacaatgcattcttgctttaaaaaaaaaaaagaaggctaaaaaattacctctttttaaattatgtgcaaaataattctggctaactgtaaaatgtattcaattttaggattttttttttttgtattgtgatgctttatttgtacatttttttcctttctggatgtaattttaatctcttgccattcattagtgttatttcattgtaaacgttattgtgccaaatgtactgtattcaaaaggatgtgaatgtgtattgtttcagaacctaataaatacaatgacgttaagtctta

SEQ ID NO: 170653 - DNA, 996 bp, Homo sapiens
  Payload ID: 13592
  Gene Symbol: PRKCE
  Gene Name: protein kinase C, epsilon
  ENST ID: ENST00000394874
  CDS Start-End: 110-769
tcggaagagctgttgattttgtagtttgttcagcgttttgcttgttagaatggagtgctgctgacttctaagccccttaggtgccagacttcaatgagcagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaagggcacaggattttccattcaaggttgtgcttgtgaagggatgagagagctgtagaattctttgcagccagagttggacaaagccaaatggctaaactcactgtttgctcattggaaaaaccaacaagtgtggttagtccttgctctgctcctaactttctatcactaatcaaatcacttaacttctaagttattttcatgtcatatgaaaaagagtaaaggccaccttaatctcttctaatctgtgtaatgtcatctgaaataaaggatgtgaacaaatgc

SEQ ID NO: 170654 - DNA, 939 bp, Homo sapiens
  Payload ID: 13592
  Gene Symbol: PRKCE
  Gene Name: protein kinase C, epsilon
  ENST ID: ENST00000421201
  CDS Start-End: 557-939
gcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgat

SEQ ID NO: 170655 - DNA, 3582 bp, Homo sapiens
  Payload ID: 13593
  Gene Symbol: PRKCH
  Gene Name: protein kinase C, eta
  Uniprot ID: P24723
  ENST ID: ENST00000332981
  CDS Start-End: 386-2437
gggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctgcctttccccagggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaa

SEQ ID NO: 170656 - DNA, 545 bp, Homo sapiens
  Payload ID: 13593
  Gene Symbol: PRKCH
  Gene Name: protein kinase C, eta
  ENST ID: ENST00000553831
  CDS Start-End: 296-545
ataaatgtaaaatgcctggcaccactgaggaagtagggtgaggagttaagttagacagtgactggcatttcccagccacactagtacagaagtgtcctgtggtacgaacggaggcaggctggggggttccattgtgtgccaggtgtttccatgaaaataaactgttgagtgccaggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcc

SEQ ID NO: 170657 - DNA, 2932 bp, Homo sapiens
  Payload ID: 13593
  Gene Symbol: PRKCH
  Gene Name: protein kinase C, eta
  Uniprot ID: P24723
  ENST ID: ENST00000555082
  CDS Start-End: 219-1787
agccggcctggacacgatcccctttcaggacagcggcttggcctaacgggaagtcgggcaggggtccagggcggtcaccctttccgcccagtctttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaa

SEQ ID NO: 170658 - DNA, 459 bp, Homo sapiens
  Payload ID: 13593
  Gene Symbol: PRKCH
  Gene Name: protein kinase C, eta
  ENST ID: ENST00000555906
  CDS Start-End: 241-459
gcggccgcgcggggaccgacgcgcgggctgaccgagtgggggccccgccgcggggcgcctccctctccgcgccgcgcaagcccggggactgctcgcgggtcgggtttcccgccagctcaggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaag

SEQ ID NO: 170659 - DNA, 521 bp, Homo sapiens
  Payload ID: 13593
  Gene Symbol: PRKCH
  Gene Name: protein kinase C, eta
  ENST ID: ENST00000555542
  CDS Start-End: 477-521
gtactccagctccttgatgccgttggaggagtagtagaggcccaggcccaggccgatgaaggccaggcccgcgcagaagaagagcggcagcgcgatgctggccgacagcagcggctgccaggcggggaggcgctgctgagtgaaggcggtgttgtcgggctggtgggcgccccgggccgtggcgctccaggtcatggcggccgcgcggggaccgacgcgcgggctgaccgagtgggggccccgccgcggggcgcctccctctccgcgccgcgcaagcccggggactgctcgcgggtcgggtttcccgccagctcaggtgggtttttgcccgggcccctcctctgcctccgtcacaggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggcc

SEQ ID NO: 170660 - DNA, 545 bp, Homo sapiens
  Payload ID: 13593
  Gene Symbol: PRKCH
  Gene Name: protein kinase C, eta
  ENST ID: ENST00000553726
  CDS Start-End: 387-545
agtacagaagtgtcctgtggtacgaacggaggcaggctggggggttccattgtgtgccaggtgtttccatgaaaataaactgttgagtgccaggtggatctcgagccagaggggaaagtatttgtggtaataacccttaccgggagtttcactgaaggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactc

SEQ ID NO: 170661 - DNA, 582 bp, Homo sapiens
  Payload ID: 13593
  Gene Symbol: PRKCH
  Gene Name: protein kinase C, eta
  ENST ID: ENST00000555185
  CDS Start-End: 129-582
agaactctgcatgcttatcggggtgtaatgcctgcctcctgctgctgctccaagctcctccaggagaaggacgctgcttctgcctggtccaggatcgtatcagggtctgggatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacaggga

SEQ ID NO: 170662 - DNA, 938 bp, Homo sapiens
  Payload ID: 13593
  Gene Symbol: PRKCH
  Gene Name: protein kinase C, eta
  ENST ID: ENST00000557585
  CDS Start-End: 266-938
atgcaaggctcctaaacttccttccctagtgcttccttaagattgaccagactttggtggaaatatgtagcagagactctttatactttttactccataaaactaaagatttgcagttgaccaagccacatgtgttcattaccttgtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgc

SEQ ID NO: 170663 - DNA, 552 bp, Homo sapiens
  Payload ID: 13593
  Gene Symbol: PRKCH
  Gene Name: protein kinase C, eta
  ENST ID: ENST00000553265
  CDS Start-End: 290-552
aaatagcactttaacaagcttggcggaggcagtggggtgaggagaggaagttaataggcccagggaggagagtatctcactggtttctccaagctgattcttctgggtgccaagagagctgtggaaacccacagaggaatgccccggttcctttccttccttctttctggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcag

SEQ ID NO: 170664 - DNA, 545 bp, Homo sapiens
  Payload ID: 13593
  Gene Symbol: PRKCH
  Gene Name: protein kinase C, eta
  ENST ID: ENST00000556778
  CDS Start-End: 157-545
atgcttatcggggtgtaatgcctgcctcctgctgctgctccaagctcctccaggagaaggacgctgcttctgcctggtccaggatcgtatcagggtctggctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgt

SEQ ID NO: 170665 - DNA, 562 bp, Homo sapiens
  Payload ID: 13593
  Gene Symbol: PRKCH
  Gene Name: protein kinase C, eta
  ENST ID: ENST00000557294
  CDS Start-End: 209-562
atgcttatcggggtgtaatgcctgcctcctgctgctgctccaagctcctccaggagaaggacgctgcttctgcctggtccaggatcgtatcagggtctggggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttc

SEQ ID NO: 170666 - DNA, 429 bp, Homo sapiens
  Payload ID: 13593
  Gene Symbol: PRKCH
  Gene Name: protein kinase C, eta
  ENST ID: ENST00000556164
  CDS Start-End: 216-429
ggctgcagcaggtgggatattttttggattatggagagctgtttgatttcacatcagtgggttcttccctcaaccttgttcagatcagtgcctgagtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggatt

SEQ ID NO: 170667 - DNA, 567 bp, Homo sapiens
  Payload ID: 13593
  Gene Symbol: PRKCH
  Gene Name: protein kinase C, eta
  ENST ID: ENST00000557473
  CDS Start-End: 249-567
gtgctacaagagattggcccatgatagccagttataaccaggcagtgggcatctcaggggtttgcataggtctaaccttaaaaagccacatgactgggtgcggtgacacacacttgtaatcccagcactttgggaggccaagacacaaggatcacctgaacctgggagttggagaccagctctggcatcacactactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggg

SEQ ID NO: 170668 - DNA, 514 bp, Homo sapiens
  Payload ID: 13593
  Gene Symbol: PRKCH
  Gene Name: protein kinase C, eta
  ENST ID: ENST00000553830
  CDS Start-End: 81-514
gtttaaactctattttcttctttcgtgtacttgctcttgatttgctgaccttctaaatggggaccagcatctaatgcttaatgcagagtgctggggacatggggaggcaggaggagctggaggctgcgtcatggaaagaccttggcgccccctcaggaaggaaggactggcttggcaggatcccaggctgttttcctggttcagccctcccgaagacattgtgttctctgcagccctggagggcctctttctctcaatttctcagtgaggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtg

SEQ ID NO: 170669 - DNA, 3133 bp, Homo sapiens
  Payload ID: 13594
  Gene Symbol: PRKCG
  Gene Name: protein kinase C, gamma
  Uniprot ID: P05129
  ENST ID: ENST00000263431
  CDS Start-End: 283-2376
cggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcggagcccgatattctccctgaccttagcgttctggactctgccccaatcgggtccagagaccacaccactaaccatccccaactccatggggttcgagactccatcttggtagttctgtgcctccccccagaccccgcccctggggaaatagcctcacggggttggctgttccagactcaggttccagaacagccctcggcctccgaggctccccgcctccactctagttctagatgagtgggaggcgtgcccccctcctccagtacgtcccgctgctgtgctctggggatttctgggatatatggaggattctttccccagaggctcccaatcagcttttgttctagacttccccatcccgaagccatcacttctccccgcagcccgcctgccgtgcatggctcctgtctggctcggacccaccccaactctccccagtgcctgccactctctgggactctcctcctcccctcctcttcccttagcctctcccacccggccacagctgctggagaataaatttgggatgctgatgctgaa

SEQ ID NO: 170670 - DNA, 560 bp, Homo sapiens
  Payload ID: 13594
  Gene Symbol: PRKCG
  Gene Name: protein kinase C, gamma
  ENST ID: ENST00000419486
  CDS Start-End: 454-560
accgccgccgcccgtgcctccggctgccggcgcccctgcctttggctcttcctccccactcgcccgctccccctggcggagccggcgcgcccggggtgccgctccctgcctggcgcgctccgcacctggagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctgga

SEQ ID NO: 170671 - DNA, 678 bp, Homo sapiens
  Payload ID: 13594
  Gene Symbol: PRKCG
  Gene Name: protein kinase C, gamma
  ENST ID: ENST00000474397
  CDS Start-End: 380-678
acacaaataatggagaggccaggggaggaaataaagactcagccggcatcggagaaaaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgt

SEQ ID NO: 170672 - DNA, 571 bp, Homo sapiens
  Payload ID: 13594
  Gene Symbol: PRKCG
  Gene Name: protein kinase C, gamma
  ENST ID: ENST00000479081
  CDS Start-End: 514-571
attcctaggtcggtttcggggccatccccgccgcctatccttcgccctaggtcacctggaggtggctggaaggccagtggactccacatttagggagagtggttacaagaggactcggattcccccaccttcccttcggctttgggaatcccaggaaacccgccccgaacccctgaaaagtcccagagaagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccct

SEQ ID NO: 170673 - DNA, 4950 bp, Homo sapiens
  Payload ID: 13595
  Gene Symbol: PRKCI
  Gene Name: protein kinase C, iota
  Uniprot ID: P41743
  ENST ID: ENST00000295797
  CDS Start-End: 306-2096
ggttgcgcccgccctaccccggaatgtgggcctttggagcgagcgaagtgggagggaccgacgcaggaggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccattga

SEQ ID NO: 170674 - DNA, 3285 bp, Homo sapiens
  Payload ID: 13596
  Gene Symbol: PRKCQ
  Gene Name: protein kinase C, theta
  Uniprot ID: Q04759
  ENST ID: ENST00000263125
  CDS Start-End: 101-2221
ccgccagccccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 170675 - DNA, 3096 bp, Homo sapiens
  Payload ID: 13596
  Gene Symbol: PRKCQ
  Gene Name: protein kinase C, theta
  Uniprot ID: Q04759
  ENST ID: ENST00000397176
  CDS Start-End: 101-2032
ccgccagccccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 170676 - DNA, 3224 bp, Homo sapiens
  Payload ID: 13596
  Gene Symbol: PRKCQ
  Gene Name: protein kinase C, theta
  Uniprot ID: Q04759
  ENST ID: ENST00000539722
  CDS Start-End: 415-2160
ccgccagccccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 170677 - DNA, 3077 bp, Homo sapiens
  Payload ID: 13596
  Gene Symbol: PRKCQ
  Gene Name: protein kinase C, theta
  ENST ID: ENST00000610727
  CDS Start-End: 1-2013
atgtcaaatgagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 170678 - DNA, 2326 bp, Homo sapiens
  Payload ID: 13597
  Gene Symbol: PRKCZ
  Gene Name: protein kinase C, zeta
  Uniprot ID: Q05513
  ENST ID: ENST00000378567
  CDS Start-End: 162-1940
gccccgcgcgccgccggagttccgcggagttgaccgggtcggcgccgtcggtcctgagcgctgccttccgcgttccgccgcggccccacctggagcccccgccccgcgccatggccggagctcccggggcgcagcgctgacggcggcggggggagcgcgccatgcccagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 170679 - DNA, 2009 bp, Homo sapiens
  Payload ID: 13597
  Gene Symbol: PRKCZ
  Gene Name: protein kinase C, zeta
  Uniprot ID: Q05513
  ENST ID: ENST00000400920
  CDS Start-End: 396-1625
agaacatcgctcggtgccagacaggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtgg

SEQ ID NO: 170680 - DNA, 2294 bp, Homo sapiens
  Payload ID: 13597
  Gene Symbol: PRKCZ
  Gene Name: protein kinase C, zeta
  Uniprot ID: Q05513
  ENST ID: ENST00000400921
  CDS Start-End: 684-1913
ctggcaggccaacctgcaggaccccgggcttagctgggttctgttctgatgtcgcattttcaaggtccgctgagtccgagccctgcctgggtctggctgctgcccgcccgctctctggactgtgctgatgcagagatgcttgttttcctgtgacgtcagcgtcagctcctgcacatccatgccgtgttttagtttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatg

SEQ ID NO: 170681 - DNA, 706 bp, Homo sapiens
  Payload ID: 13597
  Gene Symbol: PRKCZ
  Gene Name: protein kinase C, zeta
  ENST ID: ENST00000470986
  CDS Start-End: 380-706
ggcggggctgctgccggcctggactcaggaccctcaccctccagcccgcaccctcgactccccaccagccagaccctctgtcctggtgtggacagcacccacatcctggctccacccttgtttcttgccctttgacctacagcctcaggacgtgcaggagggagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgag

SEQ ID NO: 170682 - DNA, 567 bp, Homo sapiens
  Payload ID: 13597
  Gene Symbol: PRKCZ
  Gene Name: protein kinase C, zeta
  ENST ID: ENST00000470511
  CDS Start-End: 322-567
gaattcccgatgcacctccttccagcacatggactgtcagagccctgcgttgtcgccagcacagcagatctgaaaggcactaggctgtggcctcgcgacggctgagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaag

SEQ ID NO: 170683 - DNA, 468 bp, Homo sapiens
  Payload ID: 13597
  Gene Symbol: PRKCZ
  Gene Name: protein kinase C, zeta
  ENST ID: ENST00000503297
  CDS Start-End: 273-468
ggtcgctgcgggcccggggctgtcgcgggaggtcctcggtccccgcccgtgagcgtcacccgcggacacgtcgtggacagcgcgggctccttccccgggaccgggtttccctggggtcggccccgcgccgcgagctcctcggcccggtcattgtggtagacgttttcgctggaaagttgggcggggacgttccggccgcaaacctggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagaca

SEQ ID NO: 170684 - DNA, 563 bp, Homo sapiens
  Payload ID: 13597
  Gene Symbol: PRKCZ
  Gene Name: protein kinase C, zeta
  ENST ID: ENST00000496325
  CDS Start-End: 352-563
tttcgtgtgagcccacgctggccatgcacagctggcacgatcccttgcggtgtgaatacactgctggggtgggagcgccgtggccagggtcaggattcgagcggttactggcttttggtctgatggccctcggtggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacct

SEQ ID NO: 170685 - DNA, 716 bp, Homo sapiens
  Payload ID: 13597
  Gene Symbol: PRKCZ
  Gene Name: protein kinase C, zeta
  ENST ID: ENST00000471018
  CDS Start-End: 579-716
gtccgtccctcggttccgcccccggctgcgcgtctgtccctcgactcggcccctcagctgtgcgccactttctctgtggcccacagtacctccgtctccgccgcttcacacccttctctttctttctctcttcagagagggttgttgggcaggcagagcatcccccgaggggacaagtcaggcctacggactcctggagccaggacctgccgtaggctggttagggcaggatgcgccctgtcttcgtgggtagagccacatgaggggtcacccgaccccctcagggctgaggggcacaggggccgaaagtgtggccgcccctgggggtctgcgcctcttgtggagcccaggcctggcgcccagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggag

SEQ ID NO: 170686 - DNA, 763 bp, Homo sapiens
  Payload ID: 13597
  Gene Symbol: PRKCZ
  Gene Name: protein kinase C, zeta
  ENST ID: ENST00000497183
  CDS Start-End: 448-763
ccgtggtggatcctgtccgccctgcgaggacacctggctccatccacacctgggcctctgtctccagccgccgaggccgtgacaccatgaggatcataatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgagg

SEQ ID NO: 170687 - DNA, 788 bp, Homo sapiens
  Payload ID: 13597
  Gene Symbol: PRKCZ
  Gene Name: protein kinase C, zeta
  ENST ID: ENST00000470596
  CDS Start-End: 495-788
ttttttttaaaaaaaaaaacaacaaaaaaccaaaacaacaaccagcctccccagtcaggcttgtggggagccgtgggcctggggagactgggctgctgaaggtggggactgggctgctgggggaggcggctttccctctcggggggtgctggctgctggggaggctggcagcgcgcccctcccccaggtgcgaagggacctcagcagacgcagggctgctccgcacagccagcttgggccgcaggggtccttgagtgatgaagattctgtgttgatgggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaa

SEQ ID NO: 170688 - DNA, 1542 bp, Homo sapiens
  Payload ID: 13597
  Gene Symbol: PRKCZ
  Gene Name: protein kinase C, zeta
  ENST ID: ENST00000478770
  CDS Start-End: 135-1178
aggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttggtgtttcatacaaagaatacaagtaactgatgaatgaagggggcatcttgtgtccccacaatcctgctgtgcgcacaccacagctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccaggga

SEQ ID NO: 170689 - DNA, 966 bp, Homo sapiens
  Payload ID: 13597
  Gene Symbol: PRKCZ
  Gene Name: protein kinase C, zeta
  ENST ID: ENST00000486681
  CDS Start-End: 559-966
ggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggcggaacccagaggcccttagaatggccccctgatgcttggttactgacaggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgaca

SEQ ID NO: 170690 - DNA, 690 bp, Homo sapiens
  Payload ID: 13597
  Gene Symbol: PRKCZ
  Gene Name: protein kinase C, zeta
  ENST ID: ENST00000468310
  CDS Start-End: 147-690
ggagttccgcggagttgaccgggtcggcgccgtcggtcctgagcgctgccttccgcgttccgccgcggccccacctggagcccccgccccgcgccatggccggagctcccggggcgcagcgctgacggcggcggggggagcgcgccatgcccagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaagttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaa

SEQ ID NO: 170691 - DNA, 614 bp, Homo sapiens
  Payload ID: 13597
  Gene Symbol: PRKCZ
  Gene Name: protein kinase C, zeta
  ENST ID: ENST00000482686
  CDS Start-End: 396-614
agaacatcgctcggtgccagacaggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcaga

SEQ ID NO: 170692 - DNA, 713 bp, Homo sapiens
  Payload ID: 13597
  Gene Symbol: PRKCZ
  Gene Name: protein kinase C, zeta
  ENST ID: ENST00000481140
  CDS Start-End: 74-295
atttggcaagagggaggctccgtggcacgatcacacgtgcaggagctgggggctgccagagcggctgttcaagatggacttggcaaatcacctctttcaagttgccggctacccggctgccgtagacagagtgaagtctggtagtttgtgtttatttatttatcttggccagcagagagaattgagtttgcatggagactgtaatttcattctaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttac

SEQ ID NO: 170693 - DNA, 1916 bp, Homo sapiens
  Payload ID: 13597
  Gene Symbol: PRKCZ
  Gene Name: protein kinase C, zeta
  Uniprot ID: Q05513
  ENST ID: ENST00000461106
  CDS Start-End: 269-1735
gtgctgcaggccctgtgcgtgcggaggacggtgcccgagtcagcattttgggtctgagtcccggcgttgccgctgcctgtgcgctgcacagatgctccgggcagcaacacggctggtgccacggcccggggaaggcgtgcggctgcagcagctcccagcaatgtcaggggaaacgcagtgagaggctgttgttttgcgggtgacagatttttagaaaaataaggctgtggagggaccttctgagcgaggcaggggctgctggagggacatgctcaccccgaggacggatgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctg

SEQ ID NO: 170694 - DNA, 698 bp, Homo sapiens
  Payload ID: 13597
  Gene Symbol: PRKCZ
  Gene Name: protein kinase C, zeta
  ENST ID: ENST00000495347
  CDS Start-End: 636-698
gaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccggagcggtgccgctggcctgtggcttctgcagggacaagtagtggctgtggccgggaggcgttcggcagctgtgcttcagccccggccccagcttcagctcttcgagttgctggcttctctaaggcctgtcctgaagtggcctggagactgctgagttacttctggaatctgcaccgtgaaagtgaaacctggaccatgatgtgaggctgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgacctt

SEQ ID NO: 170695 - DNA, 564 bp, Homo sapiens
  Payload ID: 13597
  Gene Symbol: PRKCZ
  Gene Name: protein kinase C, zeta
  ENST ID: ENST00000466352
  CDS Start-End: 490-564
gtcatgtgtaaatattgaggcccgtttgaactatccctgtgcggaaaaaaaggcctgtttttcacagggctgcctggggaggaggggggtggaaaggaaaacaggcaggggacagacggacccggcctgcgttggcctggggtgacttcacggctccactgtcagcaagcggccgtcccgtggtggatcctgtccgccctgcgaggacacctggctccatccacacctgggcctctgtctccagccgccgaggccgtgacaccatgaggatcataatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggag

SEQ ID NO: 170696 - DNA, 480 bp, Homo sapiens
  Payload ID: 13597
  Gene Symbol: PRKCZ
  Gene Name: protein kinase C, zeta
  ENST ID: ENST00000461465
  CDS Start-End: 296-480
ggctcactccatcggggtcctcggatggtggcgaggagcggggctgcggcgtcctgttttctattctgaaatggttggagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctca

SEQ ID NO: 170697 - DNA, 3726 bp, Homo sapiens
  Payload ID: 13598
  Gene Symbol: PRKD1
  Gene Name: protein kinase D1
  Uniprot ID: Q15139
  ENST ID: ENST00000331968
  CDS Start-End: 231-2969
tcctcccgcctcggccattttccctcctccccatctcctccccttagtcccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcaggggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaa

SEQ ID NO: 170698 - DNA, 3189 bp, Homo sapiens
  Payload ID: 13598
  Gene Symbol: PRKD1
  Gene Name: protein kinase D1
  ENST ID: ENST00000415220
  CDS Start-End: 131-2893
tccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgtctcctgtgagtcctggctttgagcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcaggggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatc

SEQ ID NO: 170699 - DNA, 582 bp, Homo sapiens
  Payload ID: 13598
  Gene Symbol: PRKD1
  Gene Name: protein kinase D1
  ENST ID: ENST00000549503
  CDS Start-End: 231-582
tcttataccaatcagcctgtcaacttcagcaagagaccatacaagtggaaaagtaagacagtaagttggattaatcaagcagagaaaggagttgaaagccatagctgggtctgcaaactgaagccttctctaaattctcagaaattctggaagaaaatgttggaaattcctcaggaaatggaaagtttctcttgctgccatgatgtaagaagtgcctttcacctctcaccatgattctgagccctccccagccatgtggaactttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaaca

SEQ ID NO: 170700 - DNA, 585 bp, Homo sapiens
  Payload ID: 13598
  Gene Symbol: PRKD1
  Gene Name: protein kinase D1
  ENST ID: ENST00000546371
  CDS Start-End: 1-474
agcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagtgagtctgccagttttctaaccagcccaaagctcatcatgtgcctaccccttgcttagtaaacatgtgccctgcccttcctaagaacagaatgaagaaagacttcttggggatgacttagtttattgtagaatgtagggtgtctaaataaaagctgctgcacatactaa

SEQ ID NO: 170701 - DNA, 492 bp, Homo sapiens
  Payload ID: 13598
  Gene Symbol: PRKD1
  Gene Name: protein kinase D1
  ENST ID: ENST00000490795
  CDS Start-End: 1-243
gaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagatgttgacttgatacaatataatacctatatcttggggtgcttgagtagtcattgcactgcttgatcctcacagcaatcctctggtctcagttttcttttctgatatggtgatgctaattcctaccttactgggttattatatacaatatcaggacatgtaacttgttcatgttacagattgccatgaaaatagtgagaataagaaaagaagcacaagtatcttttttcaggaataaagaagaaacaactataaacaccagggaaatacaaaaagttgtataacaaagtcgtgtataataaagatgcaactaac

SEQ ID NO: 170702 - DNA, 3498 bp, Homo sapiens
  Payload ID: 13598
  Gene Symbol: PRKD1
  Gene Name: protein kinase D1
  Uniprot ID: Q15139
  ENST ID: ENST00000616995
  CDS Start-End: 1-2739
atgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgatcaaaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcaggggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaa

SEQ ID NO: 170703 - DNA, 3070 bp, Homo sapiens
  Payload ID: 13599
  Gene Symbol: PRKD2
  Gene Name: protein kinase D2
  Uniprot ID: Q9BZL6
  ENST ID: ENST00000291281
  CDS Start-End: 227-2863
cttctgggagccctggattccgggcctctgacccactatagtgcctttctctccttcccaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagca

SEQ ID NO: 170704 - DNA, 3321 bp, Homo sapiens
  Payload ID: 13599
  Gene Symbol: PRKD2
  Gene Name: protein kinase D2
  Uniprot ID: Q9BZL6
  ENST ID: ENST00000433867
  CDS Start-End: 479-3115
actgtcgctccggacacttcctcctgggccgccgccgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagc

SEQ ID NO: 170705 - DNA, 456 bp, Homo sapiens
  Payload ID: 13599
  Gene Symbol: PRKD2
  Gene Name: protein kinase D2
  ENST ID: ENST00000597641
  CDS Start-End: 1-222
tccggggtctcctttcacatccagatcgggctgacccgcgagttcgtgctgttgcccgccgcctccgagctggctcatgtgaagcagctggcctgttccatcgtggaccagaagcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcct

SEQ ID NO: 170706 - DNA, 2906 bp, Homo sapiens
  Payload ID: 13599
  Gene Symbol: PRKD2
  Gene Name: protein kinase D2
  Uniprot ID: Q9BZL6
  ENST ID: ENST00000601806
  CDS Start-End: 493-2658
gacttaaactttggagggggaaaaagagctactggcgcctggcgaccctccctgccccccacccaaccccgctccggcaacgcccccttcctcacggctcccgaccgaacttttctccaacttctgcgactcatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatgga

SEQ ID NO: 170707 - DNA, 624 bp, Homo sapiens
  Payload ID: 13599
  Gene Symbol: PRKD2
  Gene Name: protein kinase D2
  ENST ID: ENST00000595132
  CDS Start-End: 422-624
atttcctgcccccaggcccccaaagctgaggacccagacacctgggtcctttgagcattgggtggcaggcgccctccttatctccagcgccctcgagtccaagtcccccggcccccccccccactttcccaggagccccgaaaagtcctccttccagctcgccccaccccagtgctgggcctggagccagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctggtgaggag

SEQ ID NO: 170708 - DNA, 536 bp, Homo sapiens
  Payload ID: 13599
  Gene Symbol: PRKD2
  Gene Name: protein kinase D2
  ENST ID: ENST00000601605
  CDS Start-End: 254-536
acatccctctcccgcccctcagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatgactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggt

SEQ ID NO: 170709 - DNA, 3012 bp, Homo sapiens
  Payload ID: 13599
  Gene Symbol: PRKD2
  Gene Name: protein kinase D2
  ENST ID: ENST00000595515
  CDS Start-End: 331-2997
gacacttcctcctgggccgccgccgccgccgccgacttaaactttggagggggaaaaagagctactggcgcctggcgaccctccctgccccccacccaaccccgctccggcaacgcccccttcctcacggctcccgaccgaacttttctccaacttctgcgactcgaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggaggtgcctggggcccgcctaccccatgggcggccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcg

SEQ ID NO: 170710 - DNA, 541 bp, Homo sapiens
  Payload ID: 13599
  Gene Symbol: PRKD2
  Gene Name: protein kinase D2
  ENST ID: ENST00000598633
  CDS Start-End: 486-541
acacttcctcctgggccgccgccgccgccgccgacttaaactttggagggggaaaaagagctactggcgcctggcgaccctccctgccccccacccaaccccgctccggcaacgcccccttcctcacggctcccgaccgaacttttctccaacttctgcgactcatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaacta

SEQ ID NO: 170711 - DNA, 2923 bp, Homo sapiens
  Payload ID: 13599
  Gene Symbol: PRKD2
  Gene Name: protein kinase D2
  Uniprot ID: Q9BZL6
  ENST ID: ENST00000600194
  CDS Start-End: 555-2720
gttcattcagcatcccctcccacctccgccaggttccggaaaattcgaggtgtccacgctcccggagccactctccctcccaccccagctcccccttccagccaccaaacccacgccggcgccccctccccgtacaattggggcgctggcatcctgcccggctcgcgctggggttgggagggggcaggcaggaagcgagggcctgcggggtctctgcgtttccgggggaaacagccggccctgccctgggagggtcacagtccgcccgctgctgaaggcggctctgagcttttccgtcgccacatccctctcccgcccctcagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctc

SEQ ID NO: 170712 - DNA, 1367 bp, Homo sapiens
  Payload ID: 13599
  Gene Symbol: PRKD2
  Gene Name: protein kinase D2
  ENST ID: ENST00000597390
  CDS Start-End: 1-461
gacaagcttctctgagcatctctgtgtccaacagtcagatccaagagaatgtggacattgccactgtctaccagatcttccctgacgaagtgctgggctcagggcagtttggagtggtctatggaggaaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatttctgctttctgggctcttgcctgccccacacctaagccctgtgctaagccctttacctcctgagcttatgtaggcctcaccaccatcctaggagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcaca

SEQ ID NO: 170713 - DNA, 669 bp, Homo sapiens
  Payload ID: 13599
  Gene Symbol: PRKD2
  Gene Name: protein kinase D2
  ENST ID: ENST00000593363
  CDS Start-End: 464-669
acttcctcctgggccgccgccgccgccgccgacttaaactttggagggggaaaaagagctactggcgcctggcgaccctccctgccccccacccaaccccgctccggcaacgcccccttcctcacggctcccgaccgaacttttctccaacttctgcgactcgtgagattcccttctacccactccggccctcgggacccctctgcccatcccctggccggtcgggtccctgcgaacccctttatctctggaatccactcggtccccgactcagagactcctgccctccacccccaaggaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgt

SEQ ID NO: 170714 - DNA, 5900 bp, Homo sapiens
  Payload ID: 13600
  Gene Symbol: PRKD3
  Gene Name: protein kinase D3
  Uniprot ID: O94806
  ENST ID: ENST00000234179
  CDS Start-End: 556-3228
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaatgaaaaacaagtcaagctagcatccagttactatatagcttggctaaattatacaagacttacaagattgattactcgacaggcttgtatttaagaggtaactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctact

SEQ ID NO: 170715 - DNA, 6111 bp, Homo sapiens
  Payload ID: 13600
  Gene Symbol: PRKD3
  Gene Name: protein kinase D3
  Uniprot ID: O94806
  ENST ID: ENST00000379066
  CDS Start-End: 764-3436
ctttgtggtctacagccacaccaccccaaatgtgcctgatcttgtctgatcttggaagctaagcattgttgggcctagttaggacctggataggagaaatcccttatggctaactatatgtcagaaagcatcagcttttctcgatggacccattcatctaatgaaatatgcctgtactattttaaaaagctttgtatttcgtcatagaaaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaatgaaaaacaagtcaagctagcatccagttactatatagcttggctaaattatacaagacttacaagattgattactcgacaggcttgtatttaagaggtaactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctactaaa

SEQ ID NO: 170716 - DNA, 518 bp, Homo sapiens
  Payload ID: 13600
  Gene Symbol: PRKD3
  Gene Name: protein kinase D3
  ENST ID: ENST00000443977
  CDS Start-End: 1-518
actgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggagatttgtcagttttaagagtagttacatctctggaggacttcctgtcatcagaggaacaaagaactgtccgaggaaaacatagaaagactgggagggatgtggctattaaagtaattgataagatgagattccccacaaaacaagaaagtcaactccgtaatgaagtggctattttacagaatttgcaccatcctgggattgtaaacct

SEQ ID NO: 170717 - DNA, 555 bp, Homo sapiens
  Payload ID: 13600
  Gene Symbol: PRKD3
  Gene Name: protein kinase D3
  ENST ID: ENST00000452104
  CDS Start-End: 1-555
ctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgt

SEQ ID NO: 170718 - DNA, 695 bp, Homo sapiens
  Payload ID: 13600
  Gene Symbol: PRKD3
  Gene Name: protein kinase D3
  ENST ID: ENST00000443187
  CDS Start-End: 153-695
ggagggagggaggaaggggcgccggaggcgggcgggatcctgcgaggcgcgtgaagcctcgctggcgcctcgtccggtactcagacgctggcgggcgcagtttctcacgacgggccgagcctgccacttttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgt

SEQ ID NO: 170719 - DNA, 2502 bp, Homo sapiens
  Payload ID: 13601
  Gene Symbol: PKDCC
  Gene Name: protein kinase domain containing, cytoplasmic
  Uniprot ID: Q504Y2
  ENST ID: ENST00000294964
  CDS Start-End: 181-1662
gaggcaagtgtcaggccgatgtgtcgcccgcgaggggccggggtcggggccgccggggccatgcgcgcgggctgggcagggggccggcggggcgcagagcggagccgcctcggagcctgagccgcccggggccggggccggggagccgcgcggggccggccggccggggggaggggagcgatgcggcgccggcgggcggcagtggccgcgggtttctgcgcctccttcctgctgggctccgtcctcaacgtgctcttcgctccgggctcggagcctccgaggccaggccagtcccctgagccttcgccggccccgggtccgggccgtcgcgggggccgcggggagctggcccggcagatccgggcgcgctacgaggaggtgcagcgctattcccgcgggggccccgggcccggggcgggccggccggagcggcggcgcctgatggacctggctccgggcgggcccggcctgccgcgcccccggcccccttgggcccggcccctgtccgacggcgccccaggctggcccccggctcccggcccaggctcccccggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaactcttccctaa

SEQ ID NO: 170720 - DNA, 1550 bp, Homo sapiens
  Payload ID: 13601
  Gene Symbol: PKDCC
  Gene Name: protein kinase domain containing, cytoplasmic
  ENST ID: ENST00000401498
  CDS Start-End: 157-702
cgcccgcgaggggccggggtcggggccgccggggccatgcgcgcgggctgggcagggggccggcggggcgcagagcggagccgcctcggagcctgagccgcccggggccggggccggggagccgcgcggggccggccggccggggggaggggagcgatgcggcgccggcgggcggcagtggccgcgggtttctgcgcctccttcctgctgggctccgtcctcaacgtgctcttcgctccgggctcggagcctccgaggccaggccagtcccctgagccttcgccggccccgggtccgggccgtcgcgggggccgcggggagctggcccggcagatccgggcgcgctacgaggaggctggcccccggctcccggcccaggctcccccggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcct

SEQ ID NO: 170721 - DNA, 3069 bp, Homo sapiens
  Payload ID: 13602
  Gene Symbol: PKN1
  Gene Name: protein kinase N1
  Uniprot ID: Q16512
  ENST ID: ENST00000242783
  CDS Start-End: 166-2994
cggcggcctggccaggcgaggcgggagccgagcaggccggagcgggccgcgcgccggggagggtcgcgccgcgcccgccccctccccgccacgcccggggcgcacgcgcgctcctctggccgcccctccctccgcgcggggacccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattaacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccgga

SEQ ID NO: 170722 - DNA, 2960 bp, Homo sapiens
  Payload ID: 13602
  Gene Symbol: PKN1
  Gene Name: protein kinase N1
  Uniprot ID: Q16512
  ENST ID: ENST00000342216
  CDS Start-End: 32-2878
aagagggcggggccctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattaacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgc

SEQ ID NO: 170723 - DNA, 899 bp, Homo sapiens
  Payload ID: 13602
  Gene Symbol: PKN1
  Gene Name: protein kinase N1
  ENST ID: ENST00000586557
  CDS Start-End: 133-899
gtcgcgccgcgcccgccccctccccgccacgcccggggcgcacgcgcgctcctctggccgcccctccctccgcgcggggacccctggcgggcggcaggaggacatggccagcgacgccgtgcagtcctgctgatggcctgccggccttgccgaggagctgggcgtatctggtgttgccgatcacacaagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaaggtgaagtcagcactgtgcttaagctggataacacagtggtggggcagacgtcttggaagccatgtggccccaatgcctgggaccagagcttcactctggagctggaaagggcacgggaact

SEQ ID NO: 170724 - DNA, 867 bp, Homo sapiens
  Payload ID: 13602
  Gene Symbol: PKN1
  Gene Name: protein kinase N1
  ENST ID: ENST00000591461
  CDS Start-End: 1-597
ccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgact

SEQ ID NO: 170725 - DNA, 848 bp, Homo sapiens
  Payload ID: 13602
  Gene Symbol: PKN1
  Gene Name: protein kinase N1
  ENST ID: ENST00000590097
  CDS Start-End: 59-848
cggggacccctggcgggcggcaggaggacatggccagcgacgccgtgcagtcctgctgatggcctgccggccttgccgaggagctgggcgtatctggtgttgccgatcacacaagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcg

SEQ ID NO: 170726 - DNA, 529 bp, Homo sapiens
  Payload ID: 13602
  Gene Symbol: PKN1
  Gene Name: protein kinase N1
  ENST ID: ENST00000586237
  CDS Start-End: 1-454
tgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccgga

SEQ ID NO: 170727 - DNA, 582 bp, Homo sapiens
  Payload ID: 13602
  Gene Symbol: PKN1
  Gene Name: protein kinase N1
  ENST ID: ENST00000585619
  CDS Start-End: 539-582
aaaggcctccgccgctctcggcttgaacgcgtggaaccgttctcctcgggttcccgcgcgctccaatgggggacccctcggcagcgtgcggtcgtctcgggacccggaaagaggaaagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagct

SEQ ID NO: 170728 - DNA, 677 bp, Homo sapiens
  Payload ID: 13602
  Gene Symbol: PKN1
  Gene Name: protein kinase N1
  ENST ID: ENST00000592960
  CDS Start-End: 1-677
gaacccagagcggaggctgggatctagcgagagagatgcagaagatgtgaagaaacagcccttcttcaggccagggtctcgctctgtcgcccaggctggagtgcagtggctcaatctcggctcactgcaacctccgcctcccaggttcatgcagttctcctgcctcagcctcccgagtacctgggattacaggcgtgcaccactccaccacaccaggctaatttttgtatttttagtagagacggggtttcgccatgttggccaggctggtcctgaactcctggcctcaagtgatcctcccgcctcggcctcccgaagtgctgggattacaggcctgagccaccacgccgggcctccacttttcctaatccggcttctccaccaggctctcgcagactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatcc

SEQ ID NO: 170729 - DNA, 2632 bp, Homo sapiens
  Payload ID: 13603
  Gene Symbol: PKN2
  Gene Name: protein kinase N2
  ENST ID: ENST00000316005
  CDS Start-End: 360-2174
gcttttgcgacgcggtgacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttgttacccaggctggagtgcaatggcatgatctcggctcactgcaacctccgcctcccggattcaagcgattctcctgc

SEQ ID NO: 170730 - DNA, 2298 bp, Homo sapiens
  Payload ID: 13603
  Gene Symbol: PKN2
  Gene Name: protein kinase N2
  ENST ID: ENST00000370505
  CDS Start-End: 502-1464
gtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttgttacccaggctggagtgcaatggcatgatctcggctcactgcaacctccgcctcccggattcaagcgattctcctgc

SEQ ID NO: 170731 - DNA, 2890 bp, Homo sapiens
  Payload ID: 13603
  Gene Symbol: PKN2
  Gene Name: protein kinase N2
  Uniprot ID: Q16513
  ENST ID: ENST00000370513
  CDS Start-End: 9-2819
ggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacagggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctc

SEQ ID NO: 170732 - DNA, 6121 bp, Homo sapiens
  Payload ID: 13603
  Gene Symbol: PKN2
  Gene Name: protein kinase N2
  Uniprot ID: Q16513
  ENST ID: ENST00000370521
  CDS Start-End: 360-3314
gcttttgcgacgcggtgacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagta

SEQ ID NO: 170733 - DNA, 342 bp, Homo sapiens
  Payload ID: 13603
  Gene Symbol: PKN2
  Gene Name: protein kinase N2
  ENST ID: ENST00000449189
  CDS Start-End: 1-196
gggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagacttccgtctgagcaacacactctgcatccttgcttcaccgggaaactactgaagttcctggggaagcaaagtagaatttcgtaagaacaaaatggatggagagaggagaaaacctatggtagctgtgaaggccctgatgccatgtatgtcaaattga

SEQ ID NO: 170734 - DNA, 632 bp, Homo sapiens
  Payload ID: 13603
  Gene Symbol: PKN2
  Gene Name: protein kinase N2
  ENST ID: ENST00000436111
  CDS Start-End: 1-632
ggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacagatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagac

SEQ ID NO: 170735 - DNA, 3375 bp, Homo sapiens
  Payload ID: 13604
  Gene Symbol: PKN3
  Gene Name: protein kinase N3
  Uniprot ID: Q6P5Z2
  ENST ID: ENST00000291906
  CDS Start-End: 394-3063
ggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagagaagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgtg

SEQ ID NO: 170736 - DNA, 1134 bp, Homo sapiens
  Payload ID: 13605
  Gene Symbol: PRKAA1
  Gene Name: protein kinase, AMP-activated, alpha 1 catalytic subunit
  ENST ID: ENST00000296800
  CDS Start-End: 13-636
tcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagagactgcaatattataagaattttaacctctcaatttactaactaccagcattgagaacatgaagatatttgtacagtgtcgctttttgaatagtttggaaaacaggagaatttaatatttttaagaataactctttgtccttcactatactactgaaattgaaaacagaagctgaagtttgctagatttataatgaacttttaataacttttcacccaaaccatgcttatttgtgtgaatgttttgcatcttgattaactcaatgcagaaatactgtagtattttctatttttataagcttgttggcctagactgctcaaagaaatgagatttgtgtaaaaatatggctgtgagtaaggcaggagtacctaattttagatttgtcaagtttcatcttttttttaaatattaacttaatgtcaaaaattatttaaaaaatttttaaaaaaatggtgttgtctatcttaattcttttaggaataaaacaattcaggacatggagactgtggaaagttgttatttaaataaataaaaagaaatgttataactgtg

SEQ ID NO: 170737 - DNA, 1918 bp, Homo sapiens
  Payload ID: 13605
  Gene Symbol: PRKAA1
  Gene Name: protein kinase, AMP-activated, alpha 1 catalytic subunit
  Uniprot ID: Q13131
  ENST ID: ENST00000354209
  CDS Start-End: 186-1910
attctcctggcagcccccgcccgccccgccagggggagcgtctgcgcccgacgtaggctgcggggcctgggctggcggcgcagggcggtgactcggctcggtggctgccctcccgcgtccccaccccctccccgcccgcccccggcgcggccctgcccgccccctccgccccctcccgcagcgccatgcgcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggaaatctgatgtacctggagtagtaaaaacaggctccacgaaggagctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaa

SEQ ID NO: 170738 - DNA, 5088 bp, Homo sapiens
  Payload ID: 13605
  Gene Symbol: PRKAA1
  Gene Name: protein kinase, AMP-activated, alpha 1 catalytic subunit
  Uniprot ID: Q13131
  ENST ID: ENST00000397128
  CDS Start-End: 10-1689
cgcagcgccatgcgcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagtgtcactttgtcacccaggctggagtgcaatggtgtggtctcggctcactgcaacctccacctcccgggttcaagtgattctcccgcctcagcttcctgagtagctggaactacaggcgtgtgccaccacacccggctaatttttcgtatttttagtgtagacggggtttcactatgttgcccaggctggtctcgaactcctgaccgcgtgatccaccacctcagcttcccaaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttacctaatttttttcttgagatgcttttgtagtttttcagagttttagatgattttatacaaaatcctctgcctagcactgctctttttgatgttgtagtgacaccatttacattgaattaatgcttggtagcctggggctagatgtggaactccatggatctgtgttctgactggcacctttggaatgaaagaaaagtgtgtgctgtccaaattttttccccttaattctttccctcatcttctcacccataatagaaattttatttccattgtgagttctgacaagaatgaaattccacatacaacataactgtaaattgttggtaggtagaagttaatatttgtggttcatgtatattttgaccagagtatatttaagtatataatttcagcttccttgatttagaaatatgatataataaagaaaaactccatttatcatctgtta

SEQ ID NO: 170739 - DNA, 9347 bp, Homo sapiens
  Payload ID: 13606
  Gene Symbol: PRKAA2
  Gene Name: protein kinase, AMP-activated, alpha 2 catalytic subunit
  Uniprot ID: P54646
  ENST ID: ENST00000371244
  CDS Start-End: 67-1725
ggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatgcagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaagatttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatgatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgtgaaaaaaagaaagccacataactttgttgaactttgcccaaattaatttttcattttaaaaaacttaatagcccatgaaaagcaaatttgggaaatacattttttaggaaaatactgtcccagaatgccataattagggtagttaataattaacacttccatttctcttactggttgttgggagaatctgattgaaaattagaattactttgttttaacttgcagacatgttcatcgtgagtgaatgctggattaaatagaattttctgtgtctgcaacttgtttcatgacaccttggttttcttaatcatcttgtattattatttgagtgcaacattattcttatgcatgggtgactgaaaaacctgaaacaagattacttgttaaaaaaaagtctaagagactaatgactcatgcttatggctcagtgggtaatgaatcagtgtcactgattcttacttttaaaatgtgtagtcagtgaacattttctaaatacttttctttgggataccatatgaagatctaattccttatgtttcagtgtaggaacagctaccttctcaaatagaatatgcagggagggaagtaggcaaaccatttacaagttgggtttttgttttgattaacctgttaagagacacttttgtaatctctagtgtttacattcctttatactagctatctataaagagaatccagaaggctaaattaatcagaaataattatatttctatgtcagggtattggctatatgtagcatgaacaattctccattttctgcaaatgggtttttcaggacagttttataattctgagtttgctttttcttattccctagacagtttgtactcagggaatacaaattgatttttactgttaaatgagacatagtttagaaaaaatcataagcaactattgtagatttttgatctgtttggatttatctgtagcattgaataatgtgcagtgtactgagttaatgtaggcacctcactttggatttataaaatgtaaaaacctggaacatgcctgccacagacaccactttgtctattcaccgggtactaatttacatcctattaatggttgtaaaagctgagtgtctaaatgctagacatgttcacaattttgtctgtttttgtttatttgtttttaagacccaaaccttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatataactattttcatagaatatatttctaatttacaaacactgaattattagcttgatagagtttctcccaaaccttataaaactttgaaatgtacttatgtttgagctttaaaaattataaaaacttcatttaaacaagttgctggcatcattactagcctttccacctataattatgatgcatttgatgccactgaacagtaatagcacaaagaacaggtcacacagtctagactggattgagttttaattaaacttcttcatccatagcctgataagaatcaggctgggtctagaagagttatcagactgtaggcctgtattaattttgcaagctaatgttaatgtttactgccagccttgcatagcaatgccagtttgcagttgtgactatgatgtgacttttggtaaaaatggtttatatctaaagtagtttagattttatggaagtggctcttgattgtttggacaagcagggtaggtaaatttcaattacgtttgaagtgtaattaaatcctagaatagagcactctccagaaaaaaaaatgaaaaaagaatttggagaatatcctggcatgaaaacttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctactaatttaaacgtgcatttttcacagttacacatttaagttttgctaccaaaaatggccatttttctagacagataacattttcctaaagtggaagagagatccactgttctaaaaaaaaaaaaaaaaaaaaacactaaattgtgccttctcccttaaattataagaagagtaatagtaaaaacttgtttaaactatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaataagtatctttgatactgataggatgagtatcttgatttttaggtaagatcacagtttcacaaattgtggtgttgttaggtgacatttaatatttcttgagacctcaagtattcaaatatcaaacttgtcctgtgttgtaacaaatattcagaatctcttaaaatgttggctgaagctgccttaatgtaccaaaatacagctctcaagactgttcacaaatatctgtggttgtacaatgttttgaacatttaatgtaaagttgttgtagaactgtgaactctaaggatagtatctttattgttttaggaagaatggttgtgttctttgtcatgtatgcttaaatatacagtggattttgaatgcaacaaataaaactgaaaacagccatttggttgtgtcatgacaatcataatataggatataatatttactttttttcaaaaacatcctgcattcattcattcttagcatacctttgaaaaagaaaaaaaaatccataggttgatacattgacccattgaagtacttcattacgtatttattgaaaattttttttaattgttgaaattgggaccactttttataattggtttcaagaaaaaaaaatgaacagacttccagtgcttttctgttcaaataaactccgattcaaatttcagttttgtttgttatatactttttgtgagtgttaaatgatatgggaaggatttgtctttcattaaccatatggaaaagatgtcttcctgaattacatagcatttcatagttacagattcttcctaattaatgtttgcaccatatgaaactcataggtaacaaacacaaaggagaaaagcagcctgtctgattgcttataagcttttttcacaaaatcaaattaaaagtctctgattcatttgaaagcta

SEQ ID NO: 170740 - DNA, 9280 bp, Homo sapiens
  Payload ID: 13606
  Gene Symbol: PRKAA2
  Gene Name: protein kinase, AMP-activated, alpha 2 catalytic subunit
  ENST ID: ENST00000610361
  CDS Start-End: 1-1659
atggctgagaagcagaagcacgacgggcgggtgaagatcggacactacgtgctgggcgacacgctgggcgtcggcaccttcggcaaattgaatattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatgcagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaagatttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatgatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggcaccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgtgaaaaaaagaaagccacataactttgttgaactttgcccaaattaatttttcattttaaaaaacttaatagcccatgaaaagcaaatttgggaaatacattttttaggaaaatactgtcccagaatgccataattagggtagttaataattaacacttccatttctcttactggttgttgggagaatctgattgaaaattagaattactttgttttaacttgcagacatgttcatcgtgagtgaatgctggattaaatagaattttctgtgtctgcaacttgtttcatgacaccttggttttcttaatcatcttgtattattatttgagtgcaacattattcttatgcatgggtgactgaaaaacctgaaacaagattacttgttaaaaaaaagtctaagagactaatgactcatgcttatggctcagtgggtaatgaatcagtgtcactgattcttacttttaaaatgtgtagtcagtgaacattttctaaatacttttctttgggataccatatgaagatctaattccttatgtttcagtgtaggaacagctaccttctcaaatagaatatgcagggagggaagtaggcaaaccatttacaagttgggtttttgttttgattaacctgttaagagacacttttgtaatctctagtgtttacattcctttatactagctatctataaagagaatccagaaggctaaattaatcagaaataattatatttctatgtcagggtattggctatatgtagcatgaacaattctccattttctgcaaatgggtttttcaggacagttttataattctgagtttgctttttcttattccctagacagtttgtactcagggaatacaaattgatttttactgttaaatgagacatagtttagaaaaaatcataagcaactattgtagatttttgatctgtttggatttatctgtagcattgaataatgtgcagtgtactgagttaatgtaggcacctcactttggatttataaaatgtaaaaacctggaacatgcctgccacagacaccactttgtctattcaccgggtactaatttacatcctattaatggttgtaaaagctgagtgtctaaatgctagacatgttcacaattttgtctgtttttgtttatttgtttttaagacccaaaccttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatataactattttcatagaatatatttctaatttacaaacactgaattattagcttgatagagtttctcccaaaccttataaaactttgaaatgtacttatgtttgagctttaaaaattataaaaacttcatttaaacaagttgctggcatcattactagcctttccacctataattatgatgcatttgatgccactgaacagtaatagcacaaagaacaggtcacacagtctagactggattgagttttaattaaacttcttcatccatagcctgataagaatcaggctgggtctagaagagttatcagactgtaggcctgtattaattttgcaagctaatgttaatgtttactgccagccttgcatagcaatgccagtttgcagttgtgactatgatgtgacttttggtaaaaatggtttatatctaaagtagtttagattttatggaagtggctcttgattgtttggacaagcagggtaggtaaatttcaattacgtttgaagtgtaattaaatcctagaatagagcactctccagaaaaaaaaatgaaaaaagaatttggagaatatcctggcatgaaaacttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctactaatttaaacgtgcatttttcacagttacacatttaagttttgctaccaaaaatggccatttttctagacagataacattttcctaaagtggaagagagatccactgttctaaaaaaaaaaaaaaaaaaaaacactaaattgtgccttctcccttaaattataagaagagtaatagtaaaaacttgtttaaactatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaataagtatctttgatactgataggatgagtatcttgatttttaggtaagatcacagtttcacaaattgtggtgttgttaggtgacatttaatatttcttgagacctcaagtattcaaatatcaaacttgtcctgtgttgtaacaaatattcagaatctcttaaaatgttggctgaagctgccttaatgtaccaaaatacagctctcaagactgttcacaaatatctgtggttgtacaatgttttgaacatttaatgtaaagttgttgtagaactgtgaactctaaggatagtatctttattgttttaggaagaatggttgtgttctttgtcatgtatgcttaaatatacagtggattttgaatgcaacaaataaaactgaaaacagccatttggttgtgtcatgacaatcataatataggatataatatttactttttttcaaaaacatcctgcattcattcattcttagcatacctttgaaaaagaaaaaaaaatccataggttgatacattgacccattgaagtacttcattacgtatttattgaaaattttttttaattgttgaaattgggaccactttttataattggtttcaagaaaaaaaaatgaacagacttccagtgcttttctgttcaaataaactccgattcaaatttcagttttgtttgttatatactttttgtgagtgttaaatgatatgggaaggatttgtctttcattaaccatatggaaaagatgtcttcctgaattacatagcatttcatagttacagattcttcctaattaatgtttgcaccatatgaaactcataggtaacaaacacaaaggagaaaagcagcctgtctgattgcttataagcttttttcacaaaatcaaattaaaagtctctgattcatttgaaagct

SEQ ID NO: 170741 - DNA, 2610 bp, Homo sapiens
  Payload ID: 13607
  Gene Symbol: PRKAB1
  Gene Name: protein kinase, AMP-activated, beta 1 non-catalytic subunit
  Uniprot ID: Q9Y478
  ENST ID: ENST00000229328
  CDS Start-End: 493-1305
agcgcctcgtcctgggcctggccctgggcggccggctgctgactgcgactgcgcgctccgaggcctgcagagacggcccggggcacctgttaccgcaccgctcaagaccggaagcggaaatggaatcgagatagcctcgcgcgtttagctggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattggacatgtg

SEQ ID NO: 170742 - DNA, 583 bp, Homo sapiens
  Payload ID: 13607
  Gene Symbol: PRKAB1
  Gene Name: protein kinase, AMP-activated, beta 1 non-catalytic subunit
  ENST ID: ENST00000545223
  CDS Start-End: 397-583
attgtctgttgtagggagctcgcttatggctttctgagtaaactgctctgcttctaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttc

SEQ ID NO: 170743 - DNA, 1673 bp, Homo sapiens
  Payload ID: 13607
  Gene Symbol: PRKAB1
  Gene Name: protein kinase, AMP-activated, beta 1 non-catalytic subunit
  ENST ID: ENST00000540121
  CDS Start-End: 843-1157
cgcccggctaattttttatatttttagtagagacggggtttcaccgtgttagccaggatggtctccatctcctgacctcaggagatccgcctgcctcggcctcccaaagtgctgggattacaggcgtgagccactgaacccaccctacttattttttttttttccttctttgagatggagtctcactctgttgcccaggctggagggcagtagcacaatctcggggcactgcaaccttcgtctcccggactcaaaccatcctgcctcagcctcccgagtagctgggactacaggcgtgtgccaccatgcctggctaattttgtgtatttttggtagaggtggggtttcgccatgttgcccaggttggtcttgaactcctgacctcaagtgatccgcccgcctgggccgcccaaagtgctgcgattacaggcatgagccaccactcccggcctcaccctgcttttttttaaagcgtacatagaaaagtctttcagcttctagaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgt

SEQ ID NO: 170744 - DNA, 2303 bp, Homo sapiens
  Payload ID: 13607
  Gene Symbol: PRKAB1
  Gene Name: protein kinase, AMP-activated, beta 1 non-catalytic subunit
  Uniprot ID: Q9Y478
  ENST ID: ENST00000541640
  CDS Start-End: 192-1004
aagcggaaatggaatcgagatagcctcgcgcgtttagctggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattgga

SEQ ID NO: 170745 - DNA, 555 bp, Homo sapiens
  Payload ID: 13607
  Gene Symbol: PRKAB1
  Gene Name: protein kinase, AMP-activated, beta 1 non-catalytic subunit
  ENST ID: ENST00000537400
  CDS Start-End: 96-272
ccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggacggcagaagagaatgagagcaagcaggggaaatgccagatgcttataaaaccatcagatctcatgagactcactcactgtcagagaacagcatggggaaaccgcccccatgatcgatacctccacctggtcctgcccttgacacgtggggattatggggattacaattcaaggcaccagagaaggaggaattcctggcctggcagcatgatctggaagtgaatgataaagctcccgcccaggctcggccaacggtgtttcgatggacggggggcggaaaggaagtttacttatctgggt

SEQ ID NO: 170746 - DNA, 258 bp, Homo sapiens
  Payload ID: 13607
  Gene Symbol: PRKAB1
  Gene Name: protein kinase, AMP-activated, beta 1 non-catalytic subunit
  ENST ID: ENST00000630317
  CDS Start-End: 82-258
gttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggacggcagaagagaatga

SEQ ID NO: 170747 - DNA, 5417 bp, Homo sapiens
  Payload ID: 13608
  Gene Symbol: PRKAB2
  Gene Name: protein kinase, AMP-activated, beta 2 non-catalytic subunit
  Uniprot ID: O43741
  ENST ID: ENST00000254101
  CDS Start-End: 140-958
aatcgctggtcgccagcgaggggtgcggcttcaatttcaataactttattggtggcctgatctgcagaacagccatcacatcagtggcccttggaggagggagcgcatcgcccgaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagagccataatgactttgttgccatcctggacctccctgagggagagcaccaatacaagttctttgtggatggacagtgggttcatgatccatcagagcctgtggttaccagtcagcttggcacaattaacaatttgatccatgtcaagaaatctgattttgaggtgttcgatgctttaaagttagattctatggaaagttctgagacatcttgtagagacctttccagctcacccccagggccttatggtcaagaaatgtatgcgtttcgatctgaggaaagattcaaatccccacccatccttcctcctcatctacttcaagttattcttaacaaagacactaatatttcttgtgacccagccttactccctgagcccaaccatgttatgctgaaccatctctatgcattgtccattaaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggctatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatcattgtatattgattagttaaagggataattaatttaatgctgaggagagtttgacagattttgaaaatgagtaaaggcaaaaaaaatttttttagcctttattttgcttttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttacaactgaaaatgatctcttttaaaaagaaattaaatcagacaccacatggtggtgtccttggatctcactgtacagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtgtgtgtttgaaatacattgtgttctcagagatttctacattctcacgttctagtgatttggggcatgggcttaatagcagatgtacagtgtattcctgcattattgtgattccccttaaagcccagttcttgctgtcttctaccaggggctgctgactccagttacccatggaatgcaggacctgggaggggtagccattagggtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatcgctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaattttggtacattggagcatgttggttggtattacacggcagcatttcgaatgagtgcagctctgtgtctgtcagaaaggagagataagactactttgaagggaattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagcaataa

SEQ ID NO: 170748 - DNA, 1683 bp, Homo sapiens
  Payload ID: 13609
  Gene Symbol: PRKAG1
  Gene Name: protein kinase, AMP-activated, gamma 1 non-catalytic subunit
  Uniprot ID: P54619
  ENST ID: ENST00000316299
  CDS Start-End: 40-1062
tttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtggtgctgagggctctgtcttgtcctctaggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttc

SEQ ID NO: 170749 - DNA, 822 bp, Homo sapiens
  Payload ID: 13609
  Gene Symbol: PRKAG1
  Gene Name: protein kinase, AMP-activated, gamma 1 non-catalytic subunit
  ENST ID: ENST00000548362
  CDS Start-End: 1-282
cgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 170750 - DNA, 2071 bp, Homo sapiens
  Payload ID: 13609
  Gene Symbol: PRKAG1
  Gene Name: protein kinase, AMP-activated, gamma 1 non-catalytic subunit
  Uniprot ID: P54619
  ENST ID: ENST00000548065
  CDS Start-End: 458-1453
acagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcaccggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctc

SEQ ID NO: 170751 - DNA, 1679 bp, Homo sapiens
  Payload ID: 13609
  Gene Symbol: PRKAG1
  Gene Name: protein kinase, AMP-activated, gamma 1 non-catalytic subunit
  ENST ID: ENST00000546531
  CDS Start-End: 48-296
caagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcagtcctgcccctgtggatttgcctttatgattattactgtcttggctacaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgcttttt

SEQ ID NO: 170752 - DNA, 688 bp, Homo sapiens
  Payload ID: 13609
  Gene Symbol: PRKAG1
  Gene Name: protein kinase, AMP-activated, gamma 1 non-catalytic subunit
  ENST ID: ENST00000551696
  CDS Start-End: 81-688
tcctaaagcgaggaaaccaagccgggcgcctcttgcaatggagacggtcatttcttcagatagctccccagctgtggaaaatgagcatcctcaaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggt

SEQ ID NO: 170753 - DNA, 778 bp, Homo sapiens
  Payload ID: 13609
  Gene Symbol: PRKAG1
  Gene Name: protein kinase, AMP-activated, gamma 1 non-catalytic subunit
  ENST ID: ENST00000552463
  CDS Start-End: 403-778
ttttagaggtttgagagcgcagggttgtgagccggctttgctgggtgaggcacggggcgtccagagggatctccgcttgcaggggacccatggaagatttatgagcaagtcagtgaatgtcctttaggaatgttcatagcagctttctgtacatggactgagctacttcgaaaagtaaagtttcttgttaatggggatgaaagtcccttccaaatctgagatgctttggtgaacaaacttggtgaaagcatgaaagataaattgaagaacagatagatttgggccaaggaccccagtttaaacaacgttgcagaggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacc

SEQ ID NO: 170754 - DNA, 604 bp, Homo sapiens
  Payload ID: 13609
  Gene Symbol: PRKAG1
  Gene Name: protein kinase, AMP-activated, gamma 1 non-catalytic subunit
  ENST ID: ENST00000547082
  CDS Start-End: 397-604
atgtggggcggggcctgccccaagagagtttcctaaagcgaggaaaccaagccgggcgcctcttgcaatggagacggggacccatggaagatttatgagcaagtcagtgaatgtcctttaggaatgttcatagcagctttctgtacatggactgagctacttcgaaaagtaaagtttcttgttaatggggatgaaagtcccttccaaatctgagatgctttggtgaacaaacttggtgaaagcatgaaagataaattgaagaacagatagatttgggccaaggaccccagtttaaacaacgttgcagaggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcag

SEQ ID NO: 170755 - DNA, 553 bp, Homo sapiens
  Payload ID: 13609
  Gene Symbol: PRKAG1
  Gene Name: protein kinase, AMP-activated, gamma 1 non-catalytic subunit
  ENST ID: ENST00000548857
  CDS Start-End: 306-553
ctaaagcgaggaaaccaagccgggcgcctcttgcaatggagacggtcatttcttcagatagctccccagctgtggaaaatgagcatcctcaaggaagctactggaagatgtgttccaccaaaataagggagtaatcaaaaaagataaaaacgcgatataggagcaccagtagaggacagacgtgaaaggggtacccaggatggtgatgaagaaagatcccaggatgacagcagtgcacaccagacaaaccagcccagatttgagcagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagataga

SEQ ID NO: 170756 - DNA, 1531 bp, Homo sapiens
  Payload ID: 13609
  Gene Symbol: PRKAG1
  Gene Name: protein kinase, AMP-activated, gamma 1 non-catalytic subunit
  ENST ID: ENST00000547306
  CDS Start-End: 68-910
aaaccaagccgggcgcctcttgcaatggagacggtcatttcttcagatagctccccagctgtggaaaatgagcatcctcaaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttc

SEQ ID NO: 170757 - DNA, 1497 bp, Homo sapiens
  Payload ID: 13609
  Gene Symbol: PRKAG1
  Gene Name: protein kinase, AMP-activated, gamma 1 non-catalytic subunit
  Uniprot ID: P54619
  ENST ID: ENST00000552212
  CDS Start-End: 313-1212
ctcttgcaatggagacggtgaggagtgcaggagggcggtcgggggcgctgtggagcctaagacacccccccaacccttaggagaccgggagggccgggcaggggctggcgctggtgtctagcaaacaaaaagcagccgggtgtctgccctatcccgtgaccctgttcctccgcttcttcgttgggcgcatctcctggaactgggccgcgtccccgccgcctttccgtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtg

SEQ ID NO: 170758 - DNA, 568 bp, Homo sapiens
  Payload ID: 13609
  Gene Symbol: PRKAG1
  Gene Name: protein kinase, AMP-activated, gamma 1 non-catalytic subunit
  ENST ID: ENST00000548605
  CDS Start-End: 484-568
ctcttgcaatggagacggtcatttcttcagatagctccccagctgtggaaaatgagcatcctcaaggaagctactggaagatgtgttccaccaaaataagggagtaatcaaaaaagataaaaacgcgatataggagcaccagtagaggacagacgtgaaaggggtacccaggatggtgatgaagaaagatcccaggatgacagcagtgcacaccagacaaaccagcccagatttgagcagagaccccagaatccaacaatagcgtgtatacttccttcatgaagtctcatcgctgctatgacctgattcccacaagctccaaattggttgtatttgatacgtccctgcagtcctgcccctgtggatttgcctttatgattattactgtcttggctacaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacaca

SEQ ID NO: 170759 - DNA, 1015 bp, Homo sapiens
  Payload ID: 13609
  Gene Symbol: PRKAG1
  Gene Name: protein kinase, AMP-activated, gamma 1 non-catalytic subunit
  ENST ID: ENST00000551770
  CDS Start-End: 1-756
aatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccc

SEQ ID NO: 170760 - DNA, 612 bp, Homo sapiens
  Payload ID: 13609
  Gene Symbol: PRKAG1
  Gene Name: protein kinase, AMP-activated, gamma 1 non-catalytic subunit
  ENST ID: ENST00000551121
  CDS Start-End: 129-612
gcaatggagacggtcatttcttcagatagctccccagctgtggaaaatgagcatcctcaaggaagctactaactatcccaccctatgcagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctgg

SEQ ID NO: 170761 - DNA, 663 bp, Homo sapiens
  Payload ID: 13609
  Gene Symbol: PRKAG1
  Gene Name: protein kinase, AMP-activated, gamma 1 non-catalytic subunit
  ENST ID: ENST00000548950
  CDS Start-End: 228-663
gcctcttgcaatggagacggtcatttcttcagatagctccccagctgtggaaaatgagcatcctcaaggtgggtgaaatcctcttttcccttccccctttggagcctgtggtttaatacctctcatcctatctcatcctaagggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccag

SEQ ID NO: 170762 - DNA, 527 bp, Homo sapiens
  Payload ID: 13609
  Gene Symbol: PRKAG1
  Gene Name: protein kinase, AMP-activated, gamma 1 non-catalytic subunit
  ENST ID: ENST00000547125
  CDS Start-End: 397-527
gccgggcgcctcttgcaatggagacggctctggggtagaagttaaaaagaggaaaaagaaaactcagccaggtgtggtggctcacgcctgtaatgccagtactttgggaggccaaggcaagtggattgcttgagctcaggagttcagcatcagcctgggcaacatgatgaaagcctgtctcgacagaaacaaaaatacaaaaattacccaggcgtggtggtggtggtgtgtgcctgtagtcccagctactcgggaggctcaggtgggaggatcgcttgatccaaagaggtggaggctggagtgagctgagatcatgccactgcactccagtctgagtgacacagtgagatcctgtctccaaaaaaaaagaaaagaaagaaaactcctgctttgaaaatgttcagcctaactggagtgatggtcatttcttcagatagctccccagctgtggaaaatgagcatcctcaagagaccccagaatccaacaatagcgtgtatacttccttcatgaagtctcatcgctgcta

SEQ ID NO: 170763 - DNA, 3305 bp, Homo sapiens
  Payload ID: 13610
  Gene Symbol: PRKAG2
  Gene Name: protein kinase, AMP-activated, gamma 2 non-catalytic subunit
  Uniprot ID: Q9UGJ0
  ENST ID: ENST00000287878
  CDS Start-End: 506-2215
gagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggtttttttttttcagattgaaaaattaaaatagatcctactatctaccattttgttaaagaa

SEQ ID NO: 170764 - DNA, 2281 bp, Homo sapiens
  Payload ID: 13610
  Gene Symbol: PRKAG2
  Gene Name: protein kinase, AMP-activated, gamma 2 non-catalytic subunit
  Uniprot ID: Q9UGJ0
  ENST ID: ENST00000392801
  CDS Start-End: 444-2021
gggaatgacagtttgctgcagtcccgtcaatgggggaatctgcccgagctctgcctgcattttgagcagcaaagcagctccagccaccaagaccgttgcctgcgctgtcttaggccagcccatgctgtctgccagccgcttgttgcgctgccttggggactgggaacacacccagccccggtccccatctgttgcagacatgcagtggcagcagctcggagcacagccgaaccctagaaattgcctgtgctgaaggggctgggaaaccccttctctgatggacctttcgagtgaggcagcaggatttgtcagagctgggagtgccgcccgtccccgtcactcgcatcctgccatccagcagcttacaagcctgcactgcttattagcatctggaagagaagacctccaggaccccttggggctgagacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcc

SEQ ID NO: 170765 - DNA, 2318 bp, Homo sapiens
  Payload ID: 13610
  Gene Symbol: PRKAG2
  Gene Name: protein kinase, AMP-activated, gamma 2 non-catalytic subunit
  Uniprot ID: Q9UGJ0
  ENST ID: ENST00000418337
  CDS Start-End: 255-1241
gcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggtttttttttttcagattgaaaaattaaaatagatcctactatctacca

SEQ ID NO: 170766 - DNA, 573 bp, Homo sapiens
  Payload ID: 13610
  Gene Symbol: PRKAG2
  Gene Name: protein kinase, AMP-activated, gamma 2 non-catalytic subunit
  ENST ID: ENST00000493872
  CDS Start-End: 79-237
gcagctcatgctgatcgctgtcctcctcctccccctcaggcggcgctggcggcggccctgggacccgcggaagccggcatgctggagaagctggagttcgaggacgaagcaaggtgtcagggagcgctaattgtttgtgcttgtcaccatgcactcggaggcaaccccgaatcatacccacagtccagaccctttaatcatagactggtgcccttatctgcgcctgtgaagatatgaccgcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtga

SEQ ID NO: 170767 - DNA, 1123 bp, Homo sapiens
  Payload ID: 13610
  Gene Symbol: PRKAG2
  Gene Name: protein kinase, AMP-activated, gamma 2 non-catalytic subunit
  ENST ID: ENST00000476632
  CDS Start-End: 635-1123
aggacttcctctttcaggcccggcttgcaagagcgctagggccaagctcctttcagccctaatcggtactggagctaatcgcattcgcggcgcccgtgcactctgcagggatgggccgtggggccagggacctcagtcccctctcggcctgtcctgcccttccaggaggctagcggctgctggccgcgcagcctgccaacctgagttggccatagtagagtctcagatacccagctcctgagcggccagggccagattcagggtgtgtacgtttttggcagcggctccccaaccgagaagacactcggctgcgaagagaggacgcgaattaagagttccatgctggaaaaaaaaaaatggatagcgacaaagtgcatctacaatacgtgtagcccacggaacgatttttgttaagggggccgaggatgggcagttacatctaaaatttggaaagggaagaggaaagcgagaaaggatcccctagctggcgccccggggcgttctgcagcctccagcccctctccccctccccgcgccgcggagcccacacctgcgcaggtggagcctgccgagcgcggccgccggtgctgggaaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatc

SEQ ID NO: 170768 - DNA, 2699 bp, Homo sapiens
  Payload ID: 13610
  Gene Symbol: PRKAG2
  Gene Name: protein kinase, AMP-activated, gamma 2 non-catalytic subunit
  ENST ID: ENST00000492843
  CDS Start-End: 322-1659
gcttccggcagcttcttgctacttaaggacagccgggctgacgctccagctgctgtggccggaggtgcagccccgtcaggacggctccactccctggcgcctcacagactctggggctgcggtgaggtcgccctgaagaccccctggtgaggacgcttgaacccgggctgtcacctgagcacaggctgccactctgagcttttggggcgccctgtgcctgtcgggctgatgctcctctggctcccggccacctggggctgacaccggttctgtgggtcctgatatgttcacctgtcgccactcctgtggccacagctacccatgaagcgctttgggagcctcaggagcaacaagaaacacaaggaccaaaatcgaagcacggagaggcgccagtcggagcctcatggccttttcgcctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggttttttttttt

SEQ ID NO: 170769 - DNA, 564 bp, Homo sapiens
  Payload ID: 13610
  Gene Symbol: PRKAG2
  Gene Name: protein kinase, AMP-activated, gamma 2 non-catalytic subunit
  ENST ID: ENST00000478989
  CDS Start-End: 5-361
aggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttgtacaccaggaggatggaatcaactataccctttataaaagatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataac

SEQ ID NO: 170770 - DNA, 1413 bp, Homo sapiens
  Payload ID: 13610
  Gene Symbol: PRKAG2
  Gene Name: protein kinase, AMP-activated, gamma 2 non-catalytic subunit
  ENST ID: ENST00000488258
  CDS Start-End: 229-918
gatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagcccagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttgtaagtagtttttagcgtttct

SEQ ID NO: 170771 - DNA, 2326 bp, Homo sapiens
  Payload ID: 13611
  Gene Symbol: PRKAG3
  Gene Name: protein kinase, AMP-activated, gamma 3 non-catalytic subunit
  Uniprot ID: Q9UGI9
  ENST ID: ENST00000233944
  CDS Start-End: 47-1516
gccacagtgtcgcacacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgc

SEQ ID NO: 170772 - DNA, 2301 bp, Homo sapiens
  Payload ID: 13611
  Gene Symbol: PRKAG3
  Gene Name: protein kinase, AMP-activated, gamma 3 non-catalytic subunit
  Uniprot ID: Q9UGI9
  ENST ID: ENST00000439262
  CDS Start-End: 22-1491
agttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgc

SEQ ID NO: 170773 - DNA, 331 bp, Homo sapiens
  Payload ID: 13611
  Gene Symbol: PRKAG3
  Gene Name: protein kinase, AMP-activated, gamma 3 non-catalytic subunit
  ENST ID: ENST00000430489
  CDS Start-End: 32-331
acttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtccccggtccaggccagctgctgagtccaccgggctggaggccacattccccaagaccacacccttggctcaagctgatcct

SEQ ID NO: 170774 - DNA, 1199 bp, Homo sapiens
  Payload ID: 13611
  Gene Symbol: PRKAG3
  Gene Name: protein kinase, AMP-activated, gamma 3 non-catalytic subunit
  ENST ID: ENST00000470307
  CDS Start-End: 34-1095
acacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctgagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctg

SEQ ID NO: 170775 - DNA, 2222 bp, Homo sapiens
  Payload ID: 13611
  Gene Symbol: PRKAG3
  Gene Name: protein kinase, AMP-activated, gamma 3 non-catalytic subunit
  Uniprot ID: Q9UGI9
  ENST ID: ENST00000529249
  CDS Start-End: 317-1786
ctgctcaatgaccatgttcccacatgctccaagccacatcccctcaaaaagggtccctctagcttgtcctcagtgacccaggaggcagctgaggaccaagtacccagattatccggtgcgccccttccctcccagcaacccccagccttcagggctgtagcagctgagcaaatgggggcccctccctctcattgcctgacacccaatcagagagaaaccgatcctggcagggcagggtgcccggggccgggcccagaatagtgcagcccagccacagtgtcgcacacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggtaggctctgccctgggccatgacaccagcctcttagtcttcctgatttcctggatctcagattgggacaccctgaggatgggagtggccaagctcaaagctgagcagccctgtgaaaactgcaagtgtaaggactcacaggtccccactttgtcccattttcagctgaggtcatggagactgtcctagaagggagggacaaagccccggctaaaagctaaggctgcgatgtgacttcagacactctgggaagatttacttgttccctcacaattcaatttccacctgctggaaatccccttagaaggaagcaagctata

SEQ ID NO: 170776 - DNA, 2677 bp, Homo sapiens
  Payload ID: 13612
  Gene Symbol: PRKACA
  Gene Name: protein kinase, cAMP-dependent, catalytic, alpha
  Uniprot ID: P17612
  ENST ID: ENST00000308677
  CDS Start-End: 198-1253
cttgggctgaggttcccgggcgggcgggcgcggagagacgcgggaagcaggggctgggcgggggtcgcggcgccgcagctagcgcagccagcccgagggccgccgccgccgccgcccagcgcgctccggggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 170777 - DNA, 922 bp, Homo sapiens
  Payload ID: 13612
  Gene Symbol: PRKACA
  Gene Name: protein kinase, cAMP-dependent, catalytic, alpha
  ENST ID: ENST00000593092
  CDS Start-End: 1-624
gaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaagtaggagcctccccagccctccccttcccctgaggccggctctgctctcctgctctcgcctcctcctcaccctgtgcccccccatcttgctccagggctacaacaaggccgtggactggtgggccctgggggttcttatctatgaaatggccgctggctacccgcccttcttcgcagaccagcccatccagatctatgagaagatcgtctctgggaaggtgaggtccggatgtggggacacagccctggaagaaacagaccgttccctgctcacccatcctattccctggggagccctgcttgttgtcagaataatctagaagttccttaa

SEQ ID NO: 170778 - DNA, 1127 bp, Homo sapiens
  Payload ID: 13612
  Gene Symbol: PRKACA
  Gene Name: protein kinase, cAMP-dependent, catalytic, alpha
  Uniprot ID: P17612
  ENST ID: ENST00000589994
  CDS Start-End: 34-1065
gtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggt

SEQ ID NO: 170779 - DNA, 403 bp, Homo sapiens
  Payload ID: 13612
  Gene Symbol: PRKACA
  Gene Name: protein kinase, cAMP-dependent, catalytic, alpha
  ENST ID: ENST00000589284
  CDS Start-End: 327-403
agactgcgtctccgccccgccctctcacccccggattgacactgagcgttctgctggggggcttggcggacccggcacctccgccaatcggcggcctcgcagggcggaccccgggcccagtccagcgtctcggccaatcggacgcgtctgcccgcccagctgcggcctcgcgagcgagtgaatggccgagagtccgcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaa

SEQ ID NO: 170780 - DNA, 1101 bp, Homo sapiens
  Payload ID: 13612
  Gene Symbol: PRKACA
  Gene Name: protein kinase, cAMP-dependent, catalytic, alpha
  ENST ID: ENST00000590853
  CDS Start-End: 186-560
ttcccgggcgggcgggcgcggagagacgcgggaagcaggggctgggcgggggtcgcggcgccgcagctagcgcagccagcccgagggccgccgccgccgccgcccagcgcgctccggggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggct

SEQ ID NO: 170781 - DNA, 824 bp, Homo sapiens
  Payload ID: 13612
  Gene Symbol: PRKACA
  Gene Name: protein kinase, cAMP-dependent, catalytic, alpha
  ENST ID: ENST00000587372
  CDS Start-End: 1-755
gaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggaggg

SEQ ID NO: 170782 - DNA, 1914 bp, Homo sapiens
  Payload ID: 13613
  Gene Symbol: PRKACB
  Gene Name: protein kinase, cAMP-dependent, catalytic, beta
  ENST ID: ENST00000370680
  CDS Start-End: 313-1107
ccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagcagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaa

SEQ ID NO: 170783 - DNA, 4288 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000370682
  CDS Start-End: 32-1099
attctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataag

SEQ ID NO: 170784 - DNA, 869 bp, Homo sapiens
  Payload ID: 13613
  Gene Symbol: PRKACB
  Gene Name: protein kinase, cAMP-dependent, catalytic, beta
  ENST ID: ENST00000370684
  CDS Start-End: 97-834
aatatcagtgaggtccacagctagcagtaagagctggtgtaattgaaagacgtttaggtgcaatcattctgctgtttgctccttgccaggttcaacatgggattgttgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagaacttttgatatgaacaaaacaaaactttgagaaaaattaacag

SEQ ID NO: 170785 - DNA, 4481 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000370685
  CDS Start-End: 92-1288
acatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 170786 - DNA, 1905 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000370688
  CDS Start-End: 183-956
gttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaattcaaactagaatgtgtctctattcacattgcaaaaatattattgtctctctggttagtggctaaaagccaaattggaaactaactagttttttaaattttttaaattgtgcaaattattaaaaatccaatttggtcttata

SEQ ID NO: 170787 - DNA, 4513 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000370689
  CDS Start-End: 265-1320
gtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 170788 - DNA, 4294 bp, Homo sapiens
  Payload ID: 13613
  Gene Symbol: PRKACB
  Gene Name: protein kinase, cAMP-dependent, catalytic, beta
  ENST ID: ENST00000394838
  CDS Start-End: 32-1105
attctgctgtttgctccttgccaggttcaacatgggattgtcacgcaaatcatcagatgcatctgcttgctcctcttcagaaatatctgattttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataag

SEQ ID NO: 170789 - DNA, 4200 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000394839
  CDS Start-End: 42-1007
gttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaa

SEQ ID NO: 170790 - DNA, 648 bp, Homo sapiens
  Payload ID: 13613
  Gene Symbol: PRKACB
  Gene Name: protein kinase, cAMP-dependent, catalytic, beta
  ENST ID: ENST00000436133
  CDS Start-End: 91-648
agtgaggtccacagctagcagtaagagctggtgtaattgaaagacgtttaggtgcaatcattctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccag

SEQ ID NO: 170791 - DNA, 662 bp, Homo sapiens
  Payload ID: 13613
  Gene Symbol: PRKACB
  Gene Name: protein kinase, cAMP-dependent, catalytic, beta
  ENST ID: ENST00000432111
  CDS Start-End: 20-662
gctccttgccaggttcaacatgggattgtcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataagg

SEQ ID NO: 170792 - DNA, 944 bp, Homo sapiens
  Payload ID: 13613
  Gene Symbol: PRKACB
  Gene Name: protein kinase, cAMP-dependent, catalytic, beta
  ENST ID: ENST00000450730
  CDS Start-End: 327-944
acattttctccctgccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactcca

SEQ ID NO: 170793 - DNA, 730 bp, Homo sapiens
  Payload ID: 13613
  Gene Symbol: PRKACB
  Gene Name: protein kinase, cAMP-dependent, catalytic, beta
  ENST ID: ENST00000413538
  CDS Start-End: 104-730
gtgtttacaccatcggttcttctccctctagagattagcataactccctttgctgttggattgttattttgagcaatatgttttggaaaggttggttttcatcatgagtgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaag

SEQ ID NO: 170794 - DNA, 686 bp, Homo sapiens
  Payload ID: 13613
  Gene Symbol: PRKACB
  Gene Name: protein kinase, cAMP-dependent, catalytic, beta
  ENST ID: ENST00000417530
  CDS Start-End: 96-686
accatcggttcttctccctctagagattagcataactccctttgctgttggattgttattttgagcaatatgttttggaaaggttggttttcatcatgagtgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaata

SEQ ID NO: 170795 - DNA, 1112 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000446538
  CDS Start-End: 32-1108
attctgctgtttgctccttgccaggttcaacatgggattgtcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagag

SEQ ID NO: 170796 - DNA, 4206 bp, Homo sapiens
  Payload ID: 13613
  Gene Symbol: PRKACB
  Gene Name: protein kinase, cAMP-dependent, catalytic, beta
  ENST ID: ENST00000610457
  CDS Start-End: 1-1017
atgctgctactatctagttctataagcttatataaagacagaaatgaagcaagactgatttcttcacagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataag

SEQ ID NO: 170797 - DNA, 4306 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000614872
  CDS Start-End: 42-1115
gttattttgagcaatatgttttggaaaggttggttttcatcatgagtgcacgcaaatcatcagatgcatctgcttgctcctcttcagaaatatctgattcctttgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagac

SEQ ID NO: 170798 - DNA, 4240 bp, Homo sapiens
  Payload ID: 13613
  Gene Symbol: PRKACB
  Gene Name: protein kinase, cAMP-dependent, catalytic, beta
  Uniprot ID: P22694
  ENST ID: ENST00000610703
  CDS Start-End: 32-1051
attctgctgtttgctccttgccaggttcaacatgggattgttgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataag

SEQ ID NO: 170799 - DNA, 1609 bp, Homo sapiens
  Payload ID: 13614
  Gene Symbol: PRKACG
  Gene Name: protein kinase, cAMP-dependent, catalytic, gamma
  Uniprot ID: P22612
  ENST ID: ENST00000377276
  CDS Start-End: 22-1077
gcccctgccgccgccaccgccatgggcaacgcccccgccaagaaggacaccgagcaggaggagagcgtgaacgagttcctagccaaagccagaggagatttcctctacagatggggaaaccccgctcaaaacaccgccagctcggatcagttcgaacggctcaggacgctgggcatgggctccttcgggcgggtgatgctggtgaggcaccaggagaccggcggccactacgccatgaagatcctcaacaagcagaaggtggtgaagatgaagcaggtcgagcacatactgaacgagaagcgcatcctgcaggcgatcgactttccgttcctcgtcaagctccagttctcctttaaggacaactcctacctgtacctggtgatggagtacgtgccgggtggggagatgttctcccgcctacagcgcgtcggaaggtttagcgagccccatgcctgtttctatgccgcccaggtcgtcctggccgtccagtacctacactcgctcgacctcatccaccgcgacctgaagcccgagaatctcctcatcgaccagcagggctacctgcaggtgacggacttcggtttcgccaagcgcgtgaagggccgcacttggaccttgtgcgggaccccagagtacctggcccccgagatcatcctgagcaaaggctacaacaaggccgtggactggtgggccctaggggtgctcatctatgagatggccgtgggcttcccacccttctacgccgaccagcccatccagatctacgagaagatcgtctctgggagggtgcggtttccctccaaactcagctctgacctcaagcatctgctgcggagcctgctgcaggtggacctcaccaagcgcttcggaaacctcaggaacggggttggcgacatcaagaaccacaagtggttcgccacaaccagctggatcgccatctatgagaagaaggtggaagctcccttcatcccgaagtacacaggccctggggatgccagtaactttgacgactacgaggaggaagagctccggatctccatcaatgagaagtgtgccaaggagttttctgagttttaggggtgtgcttgtgcccctgtgggttttctttcctttttgtttttggtggtttgggggatgggagggttggattgaacagccagagggccccagagttccttgtatctaatttcatcctcaccccaccctccagggttgggggagcaggaagcccagatatttggaggaacagaaacaccagctgctccctcacccccccccatgccttcctggtccctctgtgcttctctctttctcctcccacagggtcccccttgccccagcccccttctgcctgttttaaacgagtttctcagctctattcaggccaggtcttgctgttgtatcaagggacacggtgtggaaagaggggctcaaacttaactccagccctgaacaggcaccacttactaagagaggatgaatgaaaagcacacctaccctttggcgtaatcctgcctgggaaggagagaggtttagtgccatgttcagtgggctgtttgctagaataaaaaattaaaacaaaaaacaattaaaatcttatttaagttcc

SEQ ID NO: 170800 - DNA, 3576 bp, Homo sapiens
  Payload ID: 13615
  Gene Symbol: PRKAR1A
  Gene Name: protein kinase, cAMP-dependent, regulatory, type I, alpha
  Uniprot ID: P10644
  ENST ID: ENST00000358598
  CDS Start-End: 118-1263
ggtggacagaggagcggagggacgagagggaagcgcacgatagctgcgcggagagagagcgaagagcaggcggaggaacaaaggcgacccaagacacccagagagggacagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 170801 - DNA, 3551 bp, Homo sapiens
  Payload ID: 13615
  Gene Symbol: PRKAR1A
  Gene Name: protein kinase, cAMP-dependent, regulatory, type I, alpha
  ENST ID: ENST00000392710
  CDS Start-End: 106-480
atcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataattt

SEQ ID NO: 170802 - DNA, 4327 bp, Homo sapiens
  Payload ID: 13615
  Gene Symbol: PRKAR1A
  Gene Name: protein kinase, cAMP-dependent, regulatory, type I, alpha
  Uniprot ID: P10644
  ENST ID: ENST00000392711
  CDS Start-End: 208-1353
attgacgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggtgagtggggtcggccgggggctcaggcgagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaaatgaatcagtttttcttccctttctcctttccgtctttcctctctctgtccttccccgaaagtctactcgggtgggcaaaaatgaaaagggggaaagtgaattatgggatcggtgttttgaaagagcaatgtttattttcagtgcttttcagtttgtcaaagagtggatctcaaaatcttgcttaaagggtaattgagatgtagcagatttatttacttagtcatggaaagaaaaaaattcagtcaaaagctaaagatttccttttgattgaagacagattggttctgtggccttggaactttcccagacttaatggggaaacatcatttctagattagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaact

SEQ ID NO: 170803 - DNA, 3697 bp, Homo sapiens
  Payload ID: 13615
  Gene Symbol: PRKAR1A
  Gene Name: protein kinase, cAMP-dependent, regulatory, type I, alpha
  Uniprot ID: P10644
  ENST ID: ENST00000536854
  CDS Start-End: 239-1384
atcgcagagtggagcggggctgggagcaaagcgctgagggagctcggtacgccgccgcctcgcacccgcagcctcgcgcccgccgccgcccgtccccagttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 170804 - DNA, 622 bp, Homo sapiens
  Payload ID: 13615
  Gene Symbol: PRKAR1A
  Gene Name: protein kinase, cAMP-dependent, regulatory, type I, alpha
  ENST ID: ENST00000588702
  CDS Start-End: 120-622
ggctgggagcaaagcgctgagggagctcggtacgccgccgcctcgcacccgcagcctcgcgcccgccgccgcccgtccccaggtgagtggggtcggccgggggctcaggcgagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaagg

SEQ ID NO: 170805 - DNA, 557 bp, Homo sapiens
  Payload ID: 13615
  Gene Symbol: PRKAR1A
  Gene Name: protein kinase, cAMP-dependent, regulatory, type I, alpha
  ENST ID: ENST00000585427
  CDS Start-End: 87-557
aggccgtttccggtggagctgtcgcctagccgctatcgcagagtggagcggggctgggagcaaagcgctgagggagctcgagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcc

SEQ ID NO: 170806 - DNA, 4256 bp, Homo sapiens
  Payload ID: 13615
  Gene Symbol: PRKAR1A
  Gene Name: protein kinase, cAMP-dependent, regulatory, type I, alpha
  Uniprot ID: P10644
  ENST ID: ENST00000589228
  CDS Start-End: 129-1274
ggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaaatgaatcagtttttcttccctttctcctttccgtctttcctctctctgtccttccccgaaagtctactcgggtgggcaaaaatgaaaagggggaaagtgaattatgggatcggtgttttgaaagagcaatgtttattttcagtgcttttcagtttgtcaaagagtggatctcaaaatcttgcttaaagggtaattgagatgtagcagatttatttacttagtcatggaaagaaaaaaattcagtcaaaagctaaagatttccttttgattgaagacagattggttctgtggccttggaactttcccagacttaatggggaaacatcatttctagattagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaactaaagaaaa

SEQ ID NO: 170807 - DNA, 583 bp, Homo sapiens
  Payload ID: 13615
  Gene Symbol: PRKAR1A
  Gene Name: protein kinase, cAMP-dependent, regulatory, type I, alpha
  ENST ID: ENST00000588178
  CDS Start-End: 37-583
agtggctcatacttcctcccaggagctgagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacgg

SEQ ID NO: 170808 - DNA, 1116 bp, Homo sapiens
  Payload ID: 13615
  Gene Symbol: PRKAR1A
  Gene Name: protein kinase, cAMP-dependent, regulatory, type I, alpha
  ENST ID: ENST00000589017
  CDS Start-End: 503-1116
gagcgcatcccggccatccgcccgcgctcggccccgcagcgcagctgctgcagatccgcgggggccgccacctcctccgggggctggcagcgacaggactctccccgccccggcccggggccctcccttgcaggggctgcggggaggagtcgcccacctgtcatctgagacgccccacgtgggtcggccagggagggggtggaaaggagggagaaaaggcagaggcgtcaagggaggccggagggagagtggggtggacagaggagcggagggacgagagggaagcgcacgatagctgcgcggagagagagcgaagagcaggcggaggaacaaaggcgacccaagacacccagagagggacagttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgcttt

SEQ ID NO: 170809 - DNA, 570 bp, Homo sapiens
  Payload ID: 13615
  Gene Symbol: PRKAR1A
  Gene Name: protein kinase, cAMP-dependent, regulatory, type I, alpha
  ENST ID: ENST00000586541
  CDS Start-End: 1-106
cgaccgagacagctatagaagaatcctcatgggaagcacactgagaaagcggaagatgtatgaggaattccttagtaaagtctctattttagttggtataaattaacctagccactgggctaccgaagtaaggatctaagggctatctgcaggcagtatgagaatcctgctcagactagagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcct

SEQ ID NO: 170810 - DNA, 1036 bp, Homo sapiens
  Payload ID: 13615
  Gene Symbol: PRKAR1A
  Gene Name: protein kinase, cAMP-dependent, regulatory, type I, alpha
  ENST ID: ENST00000592800
  CDS Start-End: 1-460
agggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaag

SEQ ID NO: 170811 - DNA, 1940 bp, Homo sapiens
  Payload ID: 13615
  Gene Symbol: PRKAR1A
  Gene Name: protein kinase, cAMP-dependent, regulatory, type I, alpha
  Uniprot ID: P10644
  ENST ID: ENST00000586397
  CDS Start-End: 580-1725
taattttcttgtgtgtttttaaaaattttgattatgctagtagttggctaatcagatcctcactccagtggtttgctctgtgacgttaggatactcccatgggatagaagttacgtatagggaatgtcagatattcttcattgtgctgacttgctttcgcttacagttgacttttgtgccctggtaattctgtatcctgtttaccgtttacctacttcccacgtcatcatgatttcttttgagggagaactgaatgaaattcccttaagggcctgacttcagcacccgtctctgcagaggttagtggctcatacttcctcccaggagctgaggttatcgactctcactgttgcctacagagcacagatcctgaactaaatgaaacatttacttggaataatgctaattctgtacatattttattccctagtccccacttccctgtttaaaaacaaaatctacttagaaaaaaatccctgtgaatcagttgtctaatgaatttagcaagttaaatgccagattgacattttgctttatagtttatacaagcatgtgtgtgtttttttctcgcagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatgg

SEQ ID NO: 170812 - DNA, 549 bp, Homo sapiens
  Payload ID: 13615
  Gene Symbol: PRKAR1A
  Gene Name: protein kinase, cAMP-dependent, regulatory, type I, alpha
  ENST ID: ENST00000589480
  CDS Start-End: 211-549
tttcctgaaggacaacggctctattttactggggtccgccatcgtctcgtccgccggtcctggctcttcttttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctat

SEQ ID NO: 170813 - DNA, 848 bp, Homo sapiens
  Payload ID: 13615
  Gene Symbol: PRKAR1A
  Gene Name: protein kinase, cAMP-dependent, regulatory, type I, alpha
  ENST ID: ENST00000585608
  CDS Start-End: 130-525
cggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaagttcttttctaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatg

SEQ ID NO: 170814 - DNA, 995 bp, Homo sapiens
  Payload ID: 13615
  Gene Symbol: PRKAR1A
  Gene Name: protein kinase, cAMP-dependent, regulatory, type I, alpha
  ENST ID: ENST00000585981
  CDS Start-End: 104-995
ttcgctcaccctcccccatttcctgaaggacaacggctctattttactggggtccgccatcgtctcgtccgccggtcctggctcttcttgtaagccgagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagagg

SEQ ID NO: 170815 - DNA, 407 bp, Homo sapiens
  Payload ID: 13615
  Gene Symbol: PRKAR1A
  Gene Name: protein kinase, cAMP-dependent, regulatory, type I, alpha
  ENST ID: ENST00000589309
  CDS Start-End: 271-407
gggagctcggtacgccgccgcctcgcacccgcagcctcgcgcccgccgccgcccgtccccaggacaacggctctattttactggggtccgccatcgtctcgtccgccggtcctggctcttcttgtaagccgttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacc

SEQ ID NO: 170816 - DNA, 553 bp, Homo sapiens
  Payload ID: 13615
  Gene Symbol: PRKAR1A
  Gene Name: protein kinase, cAMP-dependent, regulatory, type I, alpha
  ENST ID: ENST00000585815
  CDS Start-End: 358-553
tattttactggggtccgccatcgtctcgtccgccggtcctggctcttcttgtaagccggtagttttcctctccacttttgacgactcgtcattgctagcagtagcctttcctcttcatagcggagtgatctttcccccaacacgacggtcttagtcgggctcctgaatttcctcttgtcccctttcacctctctccctttcccaattttgcccccctgaggcctcctcgccaccactgtggccttccgactggcgtagcttgaagtctcggcttcccttcattttgtggtcatgaccgtggcctacgtgaagtgaagggcattttcctgcccttcttctagaaaatacacgagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattc

SEQ ID NO: 170817 - DNA, 1209 bp, Homo sapiens
  Payload ID: 13615
  Gene Symbol: PRKAR1A
  Gene Name: protein kinase, cAMP-dependent, regulatory, type I, alpha
  Uniprot ID: P10644
  ENST ID: ENST00000588188
  CDS Start-End: 1-1014
atggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtcacctcatcatctcaaggaggagcattcccctgggctaaggcactggggccgaactctaggagaccctaacctgtgggctgcagatcctttgggggccagaaacccaaactcacaccaagctctgtctaaggactcaatacatattatttcactcatctctatgtttcacaaaattttcaaggcatgtagttgctgttgttatgaataaaatataaattaatgtaaacatgtaa

SEQ ID NO: 170818 - DNA, 2007 bp, Homo sapiens
  Payload ID: 13616
  Gene Symbol: PRKAR1B
  Gene Name: protein kinase, cAMP-dependent, regulatory, type I, beta
  Uniprot ID: P31321
  ENST ID: ENST00000360274
  CDS Start-End: 182-1327
gcgggcggcgttgggggtgcagcagctgcgcgcggcgcgggggcgggcgtggagggcggcgccgctgcagtgcggggacccgctcgctcgctcgccagccgtccccgcgccccgcgtccccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggcc

SEQ ID NO: 170819 - DNA, 888 bp, Homo sapiens
  Payload ID: 13616
  Gene Symbol: PRKAR1B
  Gene Name: protein kinase, cAMP-dependent, regulatory, type I, beta
  ENST ID: ENST00000400758
  CDS Start-End: 1-728
ctcgtccaccccacagaggaaacgcccaccacccacgccccgggcttgtcctcatcttcagcgcgggtggccaccctcctgccccagcgccaggccccagccggcagcatgctgaggacttcctgggagaggtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaata

SEQ ID NO: 170820 - DNA, 1917 bp, Homo sapiens
  Payload ID: 13616
  Gene Symbol: PRKAR1B
  Gene Name: protein kinase, cAMP-dependent, regulatory, type I, beta
  Uniprot ID: P31321
  ENST ID: ENST00000403562
  CDS Start-End: 84-1229
gtgagggccaagcaggaacaggggtcacggggcaaggagcacgtggcagcgcaggaaacaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgc

SEQ ID NO: 170821 - DNA, 2553 bp, Homo sapiens
  Payload ID: 13616
  Gene Symbol: PRKAR1B
  Gene Name: protein kinase, cAMP-dependent, regulatory, type I, beta
  Uniprot ID: P31321
  ENST ID: ENST00000406797
  CDS Start-End: 176-1321
agtttctgccgccgccaccctggcaggatggggcaacggtgtgcggtaggaggatgaggttgattccctttcctgcagggctgggcttgtgggttaggaccgtcaccaagaggctcctcctaggcctccgtgacctctggatccccaagaaaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagta

SEQ ID NO: 170822 - DNA, 752 bp, Homo sapiens
  Payload ID: 13616
  Gene Symbol: PRKAR1B
  Gene Name: protein kinase, cAMP-dependent, regulatory, type I, beta
  ENST ID: ENST00000414568
  CDS Start-End: 244-752
cgcaggaggtgattgccggtgtttgtagagccctgtggtccatcccctcagcaccctggattcccctccccggggttttgtccacgaggagctgcttttgaccgtgtgaggtcacagcactgggtttccaacagctccctggagacctgggcggaggccacatgccattcagcacacggcagggcgtccacctcactttgggctgtccgaaaggactgcgtgtaggcggaagggcgtgtggacatggatccactggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggg

SEQ ID NO: 170823 - DNA, 1006 bp, Homo sapiens
  Payload ID: 13616
  Gene Symbol: PRKAR1B
  Gene Name: protein kinase, cAMP-dependent, regulatory, type I, beta
  ENST ID: ENST00000430040
  CDS Start-End: 116-1006
ctctggccgctaaggcagagtgagaccccagggaacgggcgtgcttgctgggtaccgggtgtcctgcagaggcagggatgtgatcccctaggtgaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggag

SEQ ID NO: 170824 - DNA, 651 bp, Homo sapiens
  Payload ID: 13616
  Gene Symbol: PRKAR1B
  Gene Name: protein kinase, cAMP-dependent, regulatory, type I, beta
  ENST ID: ENST00000417852
  CDS Start-End: 155-651
gtgggagcggggcccggggtgctcaccgggcgtggcctgcgccagggcggcggcgcagctgcagctctcgcggcgcacggcggcgaaggggtcgagcagggagcagcgcagcgcgcgcagagcgtcgtccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttataca

SEQ ID NO: 170825 - DNA, 518 bp, Homo sapiens
  Payload ID: 13616
  Gene Symbol: PRKAR1B
  Gene Name: protein kinase, cAMP-dependent, regulatory, type I, beta
  ENST ID: ENST00000456696
  CDS Start-End: 171-518
ggatccccaagaaaggtgggaaagaatttaggagggttccgatttcccactgggcatcggggtgaagctggtgcgcctaagcgctgggagtcacctggggaagcggggctgggcccacctggccaccctctctggccgctaaggcagagaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaag

SEQ ID NO: 170826 - DNA, 2533 bp, Homo sapiens
  Payload ID: 13616
  Gene Symbol: PRKAR1B
  Gene Name: protein kinase, cAMP-dependent, regulatory, type I, beta
  Uniprot ID: P31321
  ENST ID: ENST00000537384
  CDS Start-End: 155-1300
gtgggagcggggcccggggtgctcaccgggcgtggcctgcgccagggcggcggcgcagctgcagctctcgcggcgcacggcggcgaaggggtcgagcagggagcagcgcagcgcgcgcagagcgtcgtccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtac

SEQ ID NO: 170827 - DNA, 2494 bp, Homo sapiens
  Payload ID: 13616
  Gene Symbol: PRKAR1B
  Gene Name: protein kinase, cAMP-dependent, regulatory, type I, beta
  Uniprot ID: P31321
  ENST ID: ENST00000544935
  CDS Start-End: 116-1261
ctctggccgctaaggcagagtgagaccccagggaacgggcgtgcttgctgggtaccgggtgtcctgcagaggcagggatgtgatcccctaggtgaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtac

SEQ ID NO: 170828 - DNA, 6471 bp, Homo sapiens
  Payload ID: 13617
  Gene Symbol: PRKAR2A
  Gene Name: protein kinase, cAMP-dependent, regulatory, type II, alpha
  Uniprot ID: P13861
  ENST ID: ENST00000265563
  CDS Start-End: 251-1465
agctcgcctgcccgtcggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattacaggcatgcgccaccatgccgggcgaattttgtatttttaatagagacagggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaaaaaaaaaaaaaaaaaaaaggacaagaactgtcactaacctcatggaggggtttgcgtaaaaccatttagcccaccttgagcaaagggtagattccgtgttgtttttttaagctcactgtaataaaataaatctaattcagcattattgtgctacctcaaaggtaaaaaatgttttaaggtcttcttttggtcctgagttctatatacagtgtttgaaatgtccttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatcatgtctga

SEQ ID NO: 170829 - DNA, 3318 bp, Homo sapiens
  Payload ID: 13617
  Gene Symbol: PRKAR2A
  Gene Name: protein kinase, cAMP-dependent, regulatory, type II, alpha
  Uniprot ID: P13861
  ENST ID: ENST00000296446
  CDS Start-End: 233-1381
tccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattacaggcatgcgccaccatgccgggcgaattttgtatttttaatagagacagggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaa

SEQ ID NO: 170830 - DNA, 1849 bp, Homo sapiens
  Payload ID: 13617
  Gene Symbol: PRKAR2A
  Gene Name: protein kinase, cAMP-dependent, regulatory, type II, alpha
  Uniprot ID: P13861
  ENST ID: ENST00000454963
  CDS Start-End: 209-1423
agtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtc

SEQ ID NO: 170831 - DNA, 627 bp, Homo sapiens
  Payload ID: 13617
  Gene Symbol: PRKAR2A
  Gene Name: protein kinase, cAMP-dependent, regulatory, type II, alpha
  ENST ID: ENST00000437821
  CDS Start-End: 1-602
aagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgc

SEQ ID NO: 170832 - DNA, 448 bp, Homo sapiens
  Payload ID: 13617
  Gene Symbol: PRKAR2A
  Gene Name: protein kinase, cAMP-dependent, regulatory, type II, alpha
  ENST ID: ENST00000457914
  CDS Start-End: 1-277
gactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgaccaaaggaagcgccttgttgcagtttgatcttgcccacatttggacagagacacctgcctgtaccaaagggccaactgtgggagcatatgaaatctaggacccaagcaactggtagatggaaatcttgggactcactagggcccaataaactggtagctgaaccctc

SEQ ID NO: 170833 - DNA, 581 bp, Homo sapiens
  Payload ID: 13617
  Gene Symbol: PRKAR2A
  Gene Name: protein kinase, cAMP-dependent, regulatory, type II, alpha
  ENST ID: ENST00000419216
  CDS Start-End: 238-581
gtcggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagtctgtgctgagacctataaccctgatgaggaagaggaagatacagatccaagggtgattcatcctaaaactgatgaacagag

SEQ ID NO: 170834 - DNA, 624 bp, Homo sapiens
  Payload ID: 13617
  Gene Symbol: PRKAR2A
  Gene Name: protein kinase, cAMP-dependent, regulatory, type II, alpha
  ENST ID: ENST00000438535
  CDS Start-End: 1-298
ggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaaccc

SEQ ID NO: 170835 - DNA, 3745 bp, Homo sapiens
  Payload ID: 13618
  Gene Symbol: PRKAR2B
  Gene Name: protein kinase, cAMP-dependent, regulatory, type II, beta
  Uniprot ID: P31323
  ENST ID: ENST00000265717
  CDS Start-End: 260-1516
gccgcggctggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttga

SEQ ID NO: 170836 - DNA, 585 bp, Homo sapiens
  Payload ID: 13619
  Gene Symbol: PRKG1
  Gene Name: protein kinase, cGMP-dependent, type I
  ENST ID: ENST00000373976
  CDS Start-End: 1-546
agttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggctggacttggaatctgtttgaatacgttgtggaataaattccttaatttctaataaatcagtgttatattaattgg

SEQ ID NO: 170837 - DNA, 6928 bp, Homo sapiens
  Payload ID: 13619
  Gene Symbol: PRKG1
  Gene Name: protein kinase, cGMP-dependent, type I
  Uniprot ID: Q13976
  ENST ID: ENST00000373980
  CDS Start-End: 418-2478
gccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctcaggtttaatcccgggttggacctgctggtttgctctccccgctctgagcctcacagccagcccagagaagtggaatctgcactgaaactctgggtggctggagccggcggactgggcatgctcagaagccagggctggctttggtctcaagtaggaagctttggcactcgggaggcagcggcgactttggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaa

SEQ ID NO: 170838 - DNA, 6487 bp, Homo sapiens
  Payload ID: 13619
  Gene Symbol: PRKG1
  Gene Name: protein kinase, cGMP-dependent, type I
  Uniprot ID: Q13976
  ENST ID: ENST00000373985
  CDS Start-End: 22-2037
gcggaggggctcagtgaaaaaatgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaa

SEQ ID NO: 170839 - DNA, 5922 bp, Homo sapiens
  Payload ID: 13619
  Gene Symbol: PRKG1
  Gene Name: protein kinase, cGMP-dependent, type I
  ENST ID: ENST00000401604
  CDS Start-End: 95-1474
tccagctcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttg

SEQ ID NO: 170840 - DNA, 4822 bp, Homo sapiens
  Payload ID: 13620
  Gene Symbol: PRKG2
  Gene Name: protein kinase, cGMP-dependent, type II
  Uniprot ID: Q13237
  ENST ID: ENST00000264399
  CDS Start-End: 196-2484
gagccggcagccccgggcccacgctgcgcaccgtgtgcacggcggggctggctgagctgacctgcgctgggctccggcgccgcaggcggctggggagggcggcgtgggagaggacgctgagacgcaggggcggccgcgccgaggtgacaagctgcgcacctggaaagttacccggctgtctggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcgctttttaaagacatctgagtcatggatgtgtttataaatttagattgttaagacaggcaagccaccagaaaagtgataggatttcagaagtaaaagggacaacagcatccctcctatcccttccttgcactctcccaaataataagtaggatagtttcaatagcatgggacctagtacctaagaacttcactggtgaatggttgtatgtattgaccatgatcattcccttaccctccttccaaaatgaatgagaagcagagacttttctgtattttttaaatctagcagagtaaaaatactgtataagttccgggattattcaagcttctggttatattttcatatgttaatgttctatgtcaaaaggaacctctacccagtccccactcataatttcatcatccagaaaaaagccagctatatgcttccttaatgagttaagctagataagtgaagcccaatccagaaaggtgcatccttaacaaattagatttccacatttataatccttttgctgaaccaaagagtttttgtttcctggagctgtatttttaaagattatgtattgtacatagaataatcatttttaataggattgacataacctgcttaaagaatttctaagagtttttaaagatttttatttgaatttggttggtttgtactgtatgtttttccatgtatatatttttaaatttccaacctataaagatagaaaatttatgtattgggtggatattagaactatacagttataataggaatgatattctcaaagcagatcaatagttgtaatttttaaaaccctacatatatagaaataaccaagttagagtactacaggtttatttttcctgtgattgaccatgtcaatgtgttatcctcccatgtgattttttattgtttccttagagtactttaaaagatgaagaaatgagagactgaaccattgaataatcccaactccaccatttcctaactgagtgactctgggaaagtgatttagcttttttgagtactagctttctcattcatagaaaaaggcagagtaaagtaatatttacttagaggtttgtttcagggattaagttatgtagagagtcttttgcccggtatctgtgaaataaccattgctgcatagacgggagctactgttactgtctctattaaaattaaaggggccttaataaccatttagtcctgaatcttatgtatcattggtatctgtatgcagaattgtacttatcaaatccagtatctgtcttttttttcttttaaatcatgaagtaaaaatgattgaccaaaaacttcg

SEQ ID NO: 170841 - DNA, 3431 bp, Homo sapiens
  Payload ID: 13620
  Gene Symbol: PRKG2
  Gene Name: protein kinase, cGMP-dependent, type II
  Uniprot ID: Q13237
  ENST ID: ENST00000395578
  CDS Start-End: 118-2406
aggcggctggggagggcggcgtgggagaggacgctgagacgcaggggcggccgcgccgaggtgacaagctgcgcacctggaaagttacccggctgtctggtgaggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcg

SEQ ID NO: 170842 - DNA, 3852 bp, Homo sapiens
  Payload ID: 13620
  Gene Symbol: PRKG2
  Gene Name: protein kinase, cGMP-dependent, type II
  ENST ID: ENST00000545647
  CDS Start-End: 486-1514
catcccaacaggaatactatgacaaaggagattacatcattagagagggcgaggaaggaagtacctttttcattttggcaaaaggaaaggtcctccactttggacagataaaggagcttctaccagtagagtcccatgcaattctgtttgaacactggctttggagtggaggccacaggaccccctaagaaataataacttcttagtgatgttatgtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcgctttttaaagacatctgagtcatggatgtgtttataaatttagattgttaagacaggcaagccaccagaaaagtgataggatttcagaagtaaaagggacaacagcatccctcctatcccttccttgcactctcccaaataataagtaggatagtttcaatagcatgggacctagtacctaagaacttcactggtgaatggttgtatgtattgaccatgatcattcccttaccctccttccaaaatgaatgagaagcagagacttttctgtattttttaaatctagcagagtaaaaatactgtataagttccgggattattcaagcttctggttatattttcatatgttaatgttctatgtcaaaaggaacctctacccagtccccactcataatttcatcatccagaaaaaagccagctatatgcttccttaatgagttaagctagataagtgaagcccaatccagaaaggtgcatccttaacaaattagatttccacatttataatccttttgctgaaccaaagagtttttgtttcctggagctgtatttttaaagattatgtattgtacatagaataatcatttttaataggattgacataacctgcttaaagaatttctaagagtttttaaagatttttatttgaatttggttggtttgtactgtatgtttttccatgtatatatttttaaatttccaacctataaagatagaaaatttatgtattgggtggatattagaactatacagttataataggaatgatattctcaaagcagatcaatagttgtaatttttaaaaccctacatatatagaaataaccaagttagagtactacaggtttatttttcctgtgattgaccatgtcaatgtgttatcctcccatgtgattttttattgtttccttagagtactttaaaagatgaagaaatgagagactgaaccattgaataatcccaactccaccatttcctaactgagtgactctgggaaagtgatttagcttttttgagtactagctttctcattcatagaaaaaggcagagtaaagtaatatttacttagaggtttgtttcagggattaagttatgtagagagtcttttgcccggtatctgtgaaataaccattgctgcatagacgggagctactgttactgtctctattaaaattaaaggggccttaataaccatttagtcctgaatcttatgtatcattggtatctgtatgcagaattgtacttatcaaatccagtatctgtcttttttttcttttaaatcatgaagtaaaaatgattgaccaaaaacttcg

SEQ ID NO: 170843 - DNA, 2623 bp, Homo sapiens
  Payload ID: 13620
  Gene Symbol: PRKG2
  Gene Name: protein kinase, cGMP-dependent, type II
  Uniprot ID: Q13237
  ENST ID: ENST00000628926
  CDS Start-End: 143-2344
gagctgacctgcgctgggctccggcgccgcaggcggctggggagggcggcgtgggagaggacgctgagacgcaggggcggccgcgccgaggtgacaagctgcgcacctggaaagttacccggctgtctggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgtt

SEQ ID NO: 170844 - DNA, 13509 bp, Homo sapiens
  Payload ID: 13621
  Gene Symbol: PRKDC
  Gene Name: protein kinase, DNA-activated, catalytic polypeptide
  Uniprot ID: P78527
  ENST ID: ENST00000314191
  CDS Start-End: 58-12444
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 170845 - DNA, 12784 bp, Homo sapiens
  Payload ID: 13621
  Gene Symbol: PRKDC
  Gene Name: protein kinase, DNA-activated, catalytic polypeptide
  Uniprot ID: P78527
  ENST ID: ENST00000338368
  CDS Start-End: 53-12346
atttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagcta

SEQ ID NO: 170846 - DNA, 537 bp, Homo sapiens
  Payload ID: 13621
  Gene Symbol: PRKDC
  Gene Name: protein kinase, DNA-activated, catalytic polypeptide
  ENST ID: ENST00000540819
  CDS Start-End: 327-537
aaaaattgaagaaatgtaattgaagtcatgttcttttaactctttagcaatgcctgggtgggaactttttcccctttgtagtaaaagtgcctctttttagcattttaaatattcaaatacttaattatgtggatctcctgtattccttctttaaaacacgagtatgcagaccttgatgttgtgccctattaaaagcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaa

SEQ ID NO: 170847 - DNA, 659 bp, Homo sapiens
  Payload ID: 13621
  Gene Symbol: PRKDC
  Gene Name: protein kinase, DNA-activated, catalytic polypeptide
  ENST ID: ENST00000536429
  CDS Start-End: 1-271
gaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaatgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaaga

SEQ ID NO: 170848 - DNA, 1826 bp, Homo sapiens
  Payload ID: 13622
  Gene Symbol: PRKRA
  Gene Name: protein kinase, interferon-inducible double stranded RNA dependent activator
  Uniprot ID: O75569
  ENST ID: ENST00000325748
  CDS Start-End: 202-1143
gcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacata

SEQ ID NO: 170849 - DNA, 549 bp, Homo sapiens
  Payload ID: 13622
  Gene Symbol: PRKRA
  Gene Name: protein kinase, interferon-inducible double stranded RNA dependent activator
  ENST ID: ENST00000448279
  CDS Start-End: 42-329
aaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttggtgagctaaatttctttgtattcagcagctcaaaaatatcatggctgagctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcagg

SEQ ID NO: 170850 - DNA, 1344 bp, Homo sapiens
  Payload ID: 13622
  Gene Symbol: PRKRA
  Gene Name: protein kinase, interferon-inducible double stranded RNA dependent activator
  Uniprot ID: O75569
  ENST ID: ENST00000432031
  CDS Start-End: 315-1223
gcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccat

SEQ ID NO: 170851 - DNA, 1616 bp, Homo sapiens
  Payload ID: 13622
  Gene Symbol: PRKRA
  Gene Name: protein kinase, interferon-inducible double stranded RNA dependent activator
  ENST ID: ENST00000424699
  CDS Start-End: 122-439
gaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgataaaatgggaattactaagctgtaatcaggcctaaagtggcctgacttaatacagagactttctcacttctccatcacaattatttgggtagcttcggcatgcagcattctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgt

SEQ ID NO: 170852 - DNA, 942 bp, Homo sapiens
  Payload ID: 13622
  Gene Symbol: PRKRA
  Gene Name: protein kinase, interferon-inducible double stranded RNA dependent activator
  ENST ID: ENST00000457633
  CDS Start-End: 617-942
ctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttggaattggctattcatcatggctggagacttcctgaatatacc

SEQ ID NO: 170853 - DNA, 1211 bp, Homo sapiens
  Payload ID: 13622
  Gene Symbol: PRKRA
  Gene Name: protein kinase, interferon-inducible double stranded RNA dependent activator
  Uniprot ID: O75569
  ENST ID: ENST00000487082
  CDS Start-End: 214-1080
gcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactcca

SEQ ID NO: 170854 - DNA, 2171 bp, Homo sapiens
  Payload ID: 13623
  Gene Symbol: PKMYT1
  Gene Name: protein kinase, membrane associated tyrosine/threonine 1
  Uniprot ID: Q99640
  ENST ID: ENST00000262300
  CDS Start-End: 510-2009
gagcctcggagcccgggcacccctgacgggctgcactggggagggggaggagcctcgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaa

SEQ ID NO: 170855 - DNA, 1991 bp, Homo sapiens
  Payload ID: 13623
  Gene Symbol: PKMYT1
  Gene Name: protein kinase, membrane associated tyrosine/threonine 1
  ENST ID: ENST00000382240
  CDS Start-End: 331-1674
actgccattctggaagtggacaccactaactgggttttggcacgacagttatgaaaaagaaagacacttgagggattccgggttttcactttggaattggagataagggatcgtgggcccgtgtagtctcggaagaggttgtgtagtttaggatcaaagagctggccgtgatgagggcagggatgcaggcgcagcccgtctgactccaaactgccttgctcttaacccgactgcaagaccctcaagaacacgggccccatggttttcctcttatgtttctatcatctctaaaatacaacagcctggtgggcagggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctaggtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcgg

SEQ ID NO: 170856 - DNA, 2308 bp, Homo sapiens
  Payload ID: 13623
  Gene Symbol: PKMYT1
  Gene Name: protein kinase, membrane associated tyrosine/threonine 1
  ENST ID: ENST00000431515
  CDS Start-End: 387-2093
agtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggtcttaacgcccctgaggctgagccctgctgcagaacccagcgctcctggccttgggccagcagctgaagccccatgctgtgtggagcaaagaggtttcctgagcaggcacatcccccggtccttctctgcattccaggcagctccaccaaagtctgcgtgcaacgcccttcatttgcatggacacacgcaaccctcggcgtttgtatggtcattaacatgctcctcccaccacggaagaactttcgaggcccgtaccaaagtagatcctttattcaaaatctgtgggggttttttgactgtttttgctgacctgtgacctctcactgaggacggcagtccaggaccacccccagaggggttcaaagacctccgaaaccagagaccacccccacatacaggtccatggagagggcctggaccatctggacccccacggtcaggccaagtcccagataatagcaccagatgtttcctgtccgacttttggtctccccaaggcgaccagaggccgagctgcccctacacaggcgc

SEQ ID NO: 170857 - DNA, 2061 bp, Homo sapiens
  Payload ID: 13623
  Gene Symbol: PKMYT1
  Gene Name: protein kinase, membrane associated tyrosine/threonine 1
  Uniprot ID: Q99640
  ENST ID: ENST00000440027
  CDS Start-End: 362-1804
agtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctaggccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaa

SEQ ID NO: 170858 - DNA, 1091 bp, Homo sapiens
  Payload ID: 13623
  Gene Symbol: PKMYT1
  Gene Name: protein kinase, membrane associated tyrosine/threonine 1
  ENST ID: ENST00000576268
  CDS Start-End: 268-1091
acgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctgggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgg

SEQ ID NO: 170859 - DNA, 880 bp, Homo sapiens
  Payload ID: 13623
  Gene Symbol: PKMYT1
  Gene Name: protein kinase, membrane associated tyrosine/threonine 1
  ENST ID: ENST00000572059
  CDS Start-End: 439-880
cgtccggaacagtcgacggcagactccggcccgctgagccacccgaggggtcccgtggcctccgcggacccggaatctgggccctcgcggacccgcgccccgcccagtcgccccaggtgagcccagaccccgccgtgaggggcctcggcgtggccacctcgccgctcccctccgcctcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggcc

SEQ ID NO: 170860 - DNA, 1892 bp, Homo sapiens
  Payload ID: 13623
  Gene Symbol: PKMYT1
  Gene Name: protein kinase, membrane associated tyrosine/threonine 1
  Uniprot ID: Q99640
  ENST ID: ENST00000574385
  CDS Start-End: 286-1758
ctcacgggagtcctccgcccgggcgtccggaacagtcgacggcagactccggcccgctgagccacccgaggggtcccgtggcctccgcggacccggaatctgggccctcgcggacccgcgccccgcccagtcgccccagcccgtccactgctctgttcgccagggcttccccacacccacggagtgaagtcagccgcggccctgcctgggaggaacttaccgtctaccgggaaaggtggccagcagatgtgtcgggcctggtgagaggggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 170861 - DNA, 1891 bp, Homo sapiens
  Payload ID: 13623
  Gene Symbol: PKMYT1
  Gene Name: protein kinase, membrane associated tyrosine/threonine 1
  Uniprot ID: Q99640
  ENST ID: ENST00000573944
  CDS Start-End: 317-1789
ccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagaggggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcct

SEQ ID NO: 170862 - DNA, 605 bp, Homo sapiens
  Payload ID: 13623
  Gene Symbol: PKMYT1
  Gene Name: protein kinase, membrane associated tyrosine/threonine 1
  ENST ID: ENST00000575040
  CDS Start-End: 1-181
agccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggc

SEQ ID NO: 170863 - DNA, 1006 bp, Homo sapiens
  Payload ID: 13623
  Gene Symbol: PKMYT1
  Gene Name: protein kinase, membrane associated tyrosine/threonine 1
  ENST ID: ENST00000574415
  CDS Start-End: 361-1006
gggccctcgcggacccgcgccccgcccagtcgccccaggtgagcccagaccccgccgtgaggggcctcggcgtggccacctcgccgctcccctccgcctcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaagctgctttttccacctcgtgacacatccaagaggtcccctggggtcagtgcaggtcggccctggctcctccgtcgctgggtctccacagacccagcccgagggatggaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagg

SEQ ID NO: 170864 - DNA, 1806 bp, Homo sapiens
  Payload ID: 13623
  Gene Symbol: PKMYT1
  Gene Name: protein kinase, membrane associated tyrosine/threonine 1
  Uniprot ID: Q99640
  ENST ID: ENST00000574730
  CDS Start-End: 410-1702
cacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctgg

SEQ ID NO: 170865 - DNA, 979 bp, Homo sapiens
  Payload ID: 13623
  Gene Symbol: PKMYT1
  Gene Name: protein kinase, membrane associated tyrosine/threonine 1
  ENST ID: ENST00000575632
  CDS Start-End: 471-979
gtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagcccgtccactgctctgttcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctg

SEQ ID NO: 170866 - DNA, 495 bp, Homo sapiens
  Payload ID: 13623
  Gene Symbol: PKMYT1
  Gene Name: protein kinase, membrane associated tyrosine/threonine 1
  ENST ID: ENST00000572619
  CDS Start-End: 344-495
agcccagaccccgccgtgaggggcctcggcgtggccacctcgccgctcccctccgcctcgccagcccgtccactgctctgttcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcct

SEQ ID NO: 170867 - DNA, 6031 bp, Homo sapiens
  Payload ID: 13624
  Gene Symbol: PRKX
  Gene Name: protein kinase, X-linked
  Uniprot ID: P51817
  ENST ID: ENST00000262848
  CDS Start-End: 356-1432
gagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtggctcacgcctgtaatcccagcactttgggaggccgaggcaggtggatcacctgaggtcaggagttcgagaccagcctggccaacatggcaaaacccccatctctactaaaatacaaaaattaggtgtggtggcgggcacctgtaatcctggctactcgggaggctgaggcaggagaatcgcttgaacccgggaggcagaggctgcagtaagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcagaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaa

SEQ ID NO: 170868 - DNA, 1507 bp, Homo sapiens
  Payload ID: 13625
  Gene Symbol: POFUT1
  Gene Name: protein O-fucosyltransferase 1
  Uniprot ID: Q9H488
  ENST ID: ENST00000375730
  CDS Start-End: 50-634
cttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagaggcgtgagaatcactcctgtgttaccttactcttcccaaggtgaaactggaagcagcttctagagaacagcttcaggtgcagaccgagaaatgacgtcatcctgataattattggacgtgtttattaattgcaccccattagcccctgtttttaaaaaatataggttagcaggacgtgggcacaggccgtgaaacatttatagggcgcctgtcacgtgtgagacatagtaatcagaggccaatggtgatgtgtgaaaatgaggatgaccagctctggttttctaggagctatggtctcataatgacaataatcagcatagtgtacttgtccttaatgttatagcatggcaggaaagaccatgggcttagaaggcagacattggttaggaggtgcagggaacatactaattcatgtgcggtcaaagcacttggcatttaatagggcaaaggtaaacagatgtagagaaatgagtctcatgcctgtaatcccagcactttgggaggccaaggtgggtggatcacttgagcctaagagatcaaggctgcagtgagccatgatggtacccctgcactccagcccaggttacagagcaagggcctgtctcagcaaaacaaaacaagcacaggccaaggagtgagatagccagcgctgatggtatctgcctcgtagtgcatgaagtgcatgtcatacactaagcagccagccagtgttggctgtcagtgttattactcacatgctttattttatttaagactttgagatagttcatgaagtgggtattattatcaatttccattttataggtgaggaaactgagcccagtgaagttaaataacttcccaaggtcattgagctgttgagtggacagctcaggtctgtttgtaaatctttaataaataacaacagctaagattca

SEQ ID NO: 170869 - DNA, 5235 bp, Homo sapiens
  Payload ID: 13625
  Gene Symbol: POFUT1
  Gene Name: protein O-fucosyltransferase 1
  Uniprot ID: Q9H488
  ENST ID: ENST00000375749
  CDS Start-End: 63-1229
gctcgcgtccctccttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttggacgggaagcaaaaaaaaaaagttgtttaagataaattcccagaagtgaatttgttagatcaaacacttaaaactttttgttatggaagaattcaaatataaataaaaaattgtgagtaataaaatgaactcacagtttcaacaatgacccacattt

SEQ ID NO: 170870 - DNA, 4825 bp, Homo sapiens
  Payload ID: 13626
  Gene Symbol: POFUT2
  Gene Name: protein O-fucosyltransferase 2
  Uniprot ID: Q9Y2G5
  ENST ID: ENST00000331343
  CDS Start-End: 28-1302
gccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagttacgaactcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttagtaggaatctctcattgttcaccatgtgacccccaggaggtattcgacctgcactggcgtgcctggcctgggatttggtgacggagaggagggctcccagggggacatgcggtgggacaggagcgtggcggctgctgactgtggggtgtggatggggctgcagcaccaggcagagcccctcagggcgccgatgtcgagggcacctgagcgaggggtgccagcaagggggcggccggctggtgggtgctcgggggacggccgtgttggttccatgtaactgtggaactcatttcactcagctgctcctctcagttctccctgactctggaacctctgtgacgccagttctccctgactctggaacctctgtgatcctttgcaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaagttggta

SEQ ID NO: 170871 - DNA, 3077 bp, Homo sapiens
  Payload ID: 13626
  Gene Symbol: POFUT2
  Gene Name: protein O-fucosyltransferase 2
  Uniprot ID: Q9Y2G5
  ENST ID: ENST00000334538
  CDS Start-End: 28-1170
gccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaagttggta

SEQ ID NO: 170872 - DNA, 2871 bp, Homo sapiens
  Payload ID: 13626
  Gene Symbol: POFUT2
  Gene Name: protein O-fucosyltransferase 2
  Uniprot ID: Q9Y2G5
  ENST ID: ENST00000349485
  CDS Start-End: 28-1317
gccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaagttggta

SEQ ID NO: 170873 - DNA, 795 bp, Homo sapiens
  Payload ID: 13626
  Gene Symbol: POFUT2
  Gene Name: protein O-fucosyltransferase 2
  ENST ID: ENST00000451615
  CDS Start-End: 1-795
gcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagggatggaggtcttgtcagtcccaagtgtcgattgccattaaaggctctgacactaccaggcctcctgtggaaaagctgtcagttaacagcctccatgtgtccagtgccagggcagctggctctaaagcatggcagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaa

SEQ ID NO: 170874 - DNA, 2959 bp, Homo sapiens
  Payload ID: 13626
  Gene Symbol: POFUT2
  Gene Name: protein O-fucosyltransferase 2
  ENST ID: ENST00000612472
  CDS Start-End: 26-664
cggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcaggaagacgcactgcgtgtggagtatgcttcgtggtgtctcagtgcagcgccagggataaagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacaggtgcctgctgaggctgctccccctgccgcagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaagttggt

SEQ ID NO: 170875 - DNA, 2472 bp, Homo sapiens
  Payload ID: 13626
  Gene Symbol: POFUT2
  Gene Name: protein O-fucosyltransferase 2
  ENST ID: ENST00000615172
  CDS Start-End: 191-616
ctgagcccagtgtgtgccgcagcttcccacggcaggggctggcagagccggcaggggtgggcggcttgccctgcgttggcttcatgcaggagaccctccaagagcctccaccgtggatggcgctgcttctcaggcgaccgtggatgacgtgtctgaggggcttgttccagctgcggggacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtg

SEQ ID NO: 170876 - DNA, 3533 bp, Homo sapiens
  Payload ID: 13627
  Gene Symbol: POGLUT1
  Gene Name: protein O-glucosyltransferase 1
  Uniprot ID: Q8NBL1
  ENST ID: ENST00000295588
  CDS Start-End: 85-1263
gtgctgcggctcccgggccatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagccaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccaacctttccacagagaaatcacctctcttcctttgtcttttaagaactatttggtattaactagtttcagaattagtaaatgtgagattcagtcacataattatcagacattccatttgtcagaaatgtatttggctttttaaactcctttccacaaaagtttaagtctaatgaccttcttagagaagttgagcatgcctggcaagatcatttcatggaataagcagatgtttaaagttggatttttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacacaaa

SEQ ID NO: 170877 - DNA, 1361 bp, Homo sapiens
  Payload ID: 13627
  Gene Symbol: POGLUT1
  Gene Name: protein O-glucosyltransferase 1
  ENST ID: ENST00000497447
  CDS Start-End: 60-623
gtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacttgttttatttcctgtgttgcaagtgggcagaggccacatttgtgttgcatttcccatggtctagcctcatttctcgaaagtgtttggttccattgtttgtcatgaaactcactcagaagaacagatagaggctcccatgctagactttggaaaatagggaaaatatatctttgacaatgtgacactaaaccaaggctgtccagatcctgtggcatgattgcagttgcctcttttcactgttccaagactgatttaggacgacctgtctgtttttgttgaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagtaatcaccagtcatctgactagaactacagcagtgaacattctcactcaaagaacattgccacctgggtagaatttgagattaggtttcctgtcagtggtgaggataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagct

SEQ ID NO: 170878 - DNA, 567 bp, Homo sapiens
  Payload ID: 13627
  Gene Symbol: POGLUT1
  Gene Name: protein O-glucosyltransferase 1
  ENST ID: ENST00000476573
  CDS Start-End: 1-567
gtgcggggccgcgcttccgccagcgccgcagcggggaatctgcagttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaa

SEQ ID NO: 170879 - DNA, 1420 bp, Homo sapiens
  Payload ID: 13627
  Gene Symbol: POGLUT1
  Gene Name: protein O-glucosyltransferase 1
  ENST ID: ENST00000486607
  CDS Start-End: 60-551
gtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaaggctagactttggaaaatagggaaaatatatctttgacaatgtgacactaaaccaaggctgtccagatcctgtggcatgattgcagttgcctcttttcactgttccaagactgatttaggacgacctgtctgtttttgttgaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacaga

SEQ ID NO: 170880 - DNA, 589 bp, Homo sapiens
  Payload ID: 13627
  Gene Symbol: POGLUT1
  Gene Name: protein O-glucosyltransferase 1
  ENST ID: ENST00000460339
  CDS Start-End: 23-358
atctgcagtaggtctgccggcgatggagtggtgggctagctcgccgcttcggctctggctgctgttgttcctcctgccctcagcgcagggccgccagaaggagtcaggtgggctccgggcagtgccgagcctgccccttgggctcggggtctggccggagtcccgaggcgctcccccgcgcggccggctcccgggaagatgccgtggccgctgtagctcggagctgggcagaaggcaccggggcgccttgcggcggagagttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttccta

SEQ ID NO: 170881 - DNA, 2728 bp, Homo sapiens
  Payload ID: 13628
  Gene Symbol: POMGNT1
  Gene Name: protein O-linked mannose N-acetylglucosaminyltransferase 1 (beta 1,2-)
  Uniprot ID: Q8WZA1
  ENST ID: ENST00000371984
  CDS Start-End: 159-2141
ggccggggcggggccgcaagcggcatggaggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 170882 - DNA, 2934 bp, Homo sapiens
  Payload ID: 13628
  Gene Symbol: POMGNT1
  Gene Name: protein O-linked mannose N-acetylglucosaminyltransferase 1 (beta 1,2-)
  Uniprot ID: Q8WZA1
  ENST ID: ENST00000371992
  CDS Start-End: 652-2898
ctcagactgagggagaatcaattttgggggagaccacatctaatggataaaagagccacaggattacaaaagggtggaatagttgttacaagaaggtcacatcatcctggcactgctcccagaaccagtgggcctcgaagcccagcttggcactctcatcctctggtgactcaggtggtccaccttgaagcctctcccctgggggcttccacacagctctcaagctccctagcctggtggctgccacatccacctcagtcctggccctctctccaccagctataacttttgcccagtccatctcggaacgtggagccccaggtgggccctgttcatccagctcgctgggggccactgtgtccaggaagctgccaatagagacactgtccagccggtcggtggtgctggtgtctggcaggctgtcccagctgcctcgccttgagcggcctgggctcccgcctgtcaggctatattgactgctggtgaggctgctgcaatgactggtcaacgtcccccgctcctccaacagccagcgcactgcctcgatgccctcattcaaggtcaccagctgctgcaggatcttcacatcgatggctcgcagattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatgagtgaagaagccaccctcagtcaccccaattttcctggagccacccccaaaggaggagggagccccaggagccccagaacagacatgagacctcctccaggaccctgcggggctgggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 170883 - DNA, 3480 bp, Homo sapiens
  Payload ID: 13628
  Gene Symbol: POMGNT1
  Gene Name: protein O-linked mannose N-acetylglucosaminyltransferase 1 (beta 1,2-)
  ENST ID: ENST00000396420
  CDS Start-End: 638-1240
gaatcaattttgggggagaccacatctaatggataaaagagccacaggattacaaaagggtggaatagttgttacaagaaggtcacatcatcctggcactgctcccagaaccagtgggcctcgaagcccagcttggcactctcatcctctggtgactcaggtggtccaccttgaagcctctcccctgggggcttccacacagctctcaagctccctagcctggtggctgccacatccacctcagtcctggccctctctccaccagctataacttttgcccagtccatctcggaacgtggagccccaggtgggccctgttcatccagctcgctgggggccactgtgtccaggaagctgccaatagagacactgtccagccggtcggtggtgctggtgtctggcaggctgtcccagctgcctcgccttgagcggcctgggctcccgcctgtcaggctatattgactgctggtgaggctgctgcaatgactggtcaacgtcccccgctcctccaacagccagcgcactgcctcgatgccctcattcaaggtcaccagctgctgcaggatcttcacatcgatggctcgcagattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggtaagcctgggaatgggctatacccagcactgaacaggagggtgcttaggtcatctacctccaggaggaactcttgaggtgggcagaaaggcaatagattctagacgcattcacctctgtgggtaagcatagggactctgggcccagctgtaaacacaggggaacctgagttgaggggtgatgaagtgaccctaacctatccctgggctccccaggatgctgcgctctctgctttcagcccagggggtgtctcctcagatgataacagttttcattgacggctactatgaggtgagcaggacttggggggtgcctcgggtggagtacaacatggagcagcagtgattgccagggacgggcaagggagaccgcccaggcaagggctgtgaaatgtgaaggccttggattgcagaggtgggcagagggaaagtgacctcacatggtgagcagtggccatgtcccccaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctgatggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctgggg

SEQ ID NO: 170884 - DNA, 2544 bp, Homo sapiens
  Payload ID: 13629
  Gene Symbol: POMGNT2
  Gene Name: protein O-linked mannose N-acetylglucosaminyltransferase 2 (beta 1,4-)
  Uniprot ID: Q8NAT1
  ENST ID: ENST00000344697
  CDS Start-End: 347-2089
caggctccgcgccgggctcgcccgccgggcaggcgcacggcggacacctgcgagcctggaggtggcggtcgctgcgaacccggcggcgcggccaaacctgtgctggctgcctgggccttctgggcctcctgggccagaagctggcgctgggggcggcggcggggtgggaaagcggcgccgccgtggggcctcctggacgcgtcggcggaggtggcttcgtcccgcggagtccaggcttcaggctttcaccagttctcaggatgcccatagggatgggtgaagcctgcctggcctgtggtgcttcccagtggccgtcatctcattagggccccacagtggcattaggatgcacctctcggcggtgttcaacgccctcctggtgtcggtgctggcagcggtcctgtggaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacactccctataagacgctggccatgctgcctggcatggacctccagtatgtagcctggcggaacatgatgccagagaacacagtcacacaccctgagcggccctgggatcaggggggcatcacccatctggaccgggctgagcaagcccgtatcctgcaaagccgtgaggtcccacggcatctctgttgccggaaccccgagtggctcttccgaatctaccaggacaccaaggtggacatcccgtccctcattcaaaccatacggcgcgtggtgaagggccggccaggaccacggaagcagaagtggacagtcggcctatatccaggcaaggtgcgggaggcacggtgccaggcgtcagtgcatggcgcctccgaggcccgcctcactgtctcctggcagatcccatggaaccttaaatacctgaaggtgagggaggtgaagtacgaggtgtggctgcaggagcagggggagaacacctacgtgccttacatcctggctctgcagaaccacaccttcactgagaacatcaagcccttcaccacctacctggtgtgggtccgctgcatcttcaacaagatcctcctgggaccctttgcagatgtgctggtgtgcaacacgtagcgagcaggccacagcctggcctcgggaaggtggctcctgcagttcagcgtccctgggcccattaatcccactgtggagacttctgggaactatttattgagcaggcctgtgcctccacatcatcttgttgtctctggggtgtggtgtcacagcactcctctttgccctagagataagggacctgacttccccttctcccatcctgaacatttgtacccctggagaagttccttagcagggaggaggaagaggagaggaggaagcaaagaatcacaaggaacctctggctaggtgatcctgatgtttcctactgagtttttctggtatccagatttctggaaaccgagtaatcatgtactgtttgattgggtggttcatctgcttccatcccagtgaaatttacctgtagcccagtgaagggtgtgtttggaacattcattaaatgattctaagca

SEQ ID NO: 170885 - DNA, 2531 bp, Homo sapiens
  Payload ID: 13629
  Gene Symbol: POMGNT2
  Gene Name: protein O-linked mannose N-acetylglucosaminyltransferase 2 (beta 1,4-)
  Uniprot ID: Q8NAT1
  ENST ID: ENST00000441964
  CDS Start-End: 332-2074
aagctggcgctgggggcggcggcggggtgggaaagcggcgccgccgtggggcctcctggacgcgtcggcggaggtggcttcgtcccgcggagtccaggcttcagctcctggcttctcttctttcctcctagagatcagatgtcggaactccagctgagggcatgtcttactgggcacgcaggtgtcctctcttgagaagaactgtccataccatggtggtggtaaggctttcaccagttctcaggatgcccatagggatgggtgaagcctgcctggcctgtggtgcttcccagtggccgtcatctcattagggccccacagtggcattaggatgcacctctcggcggtgttcaacgccctcctggtgtcggtgctggcagcggtcctgtggaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacactccctataagacgctggccatgctgcctggcatggacctccagtatgtagcctggcggaacatgatgccagagaacacagtcacacaccctgagcggccctgggatcaggggggcatcacccatctggaccgggctgagcaagcccgtatcctgcaaagccgtgaggtcccacggcatctctgttgccggaaccccgagtggctcttccgaatctaccaggacaccaaggtggacatcccgtccctcattcaaaccatacggcgcgtggtgaagggccggccaggaccacggaagcagaagtggacagtcggcctatatccaggcaaggtgcgggaggcacggtgccaggcgtcagtgcatggcgcctccgaggcccgcctcactgtctcctggcagatcccatggaaccttaaatacctgaaggtgagggaggtgaagtacgaggtgtggctgcaggagcagggggagaacacctacgtgccttacatcctggctctgcagaaccacaccttcactgagaacatcaagcccttcaccacctacctggtgtgggtccgctgcatcttcaacaagatcctcctgggaccctttgcagatgtgctggtgtgcaacacgtagcgagcaggccacagcctggcctcgggaaggtggctcctgcagttcagcgtccctgggcccattaatcccactgtggagacttctgggaactatttattgagcaggcctgtgcctccacatcatcttgttgtctctggggtgtggtgtcacagcactcctctttgccctagagataagggacctgacttccccttctcccatcctgaacatttgtacccctggagaagttccttagcagggaggaggaagaggagaggaggaagcaaagaatcacaaggaacctctggctaggtgatcctgatgtttcctactgagtttttctggtatccagatttctggaaaccgagtaatcatgtactgtttgattgggtggttcatctgcttccatcccagtgaaatttacctgtagcccagtgaagggtgtgtttggaacattcattaaatgattctaagcatc

SEQ ID NO: 170886 - DNA, 1389 bp, Homo sapiens
  Payload ID: 13630
  Gene Symbol: PPP1CA
  Gene Name: protein phosphatase 1, catalytic subunit, alpha isozyme
  Uniprot ID: P62136
  ENST ID: ENST00000312989
  CDS Start-End: 12-1037
gcggcgccgccatgtccgacagcgagaagctcaacctggactcgatcatcgggcgcctgctggaagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctc

SEQ ID NO: 170887 - DNA, 1054 bp, Homo sapiens
  Payload ID: 13630
  Gene Symbol: PPP1CA
  Gene Name: protein phosphatase 1, catalytic subunit, alpha isozyme
  Uniprot ID: P62136
  ENST ID: ENST00000358239
  CDS Start-End: 90-950
cggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaaggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacg

SEQ ID NO: 170888 - DNA, 1476 bp, Homo sapiens
  Payload ID: 13630
  Gene Symbol: PPP1CA
  Gene Name: protein phosphatase 1, catalytic subunit, alpha isozyme
  Uniprot ID: P62136
  ENST ID: ENST00000376745
  CDS Start-End: 150-1142
gcggggcgggcccgggaggcctggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaa

SEQ ID NO: 170889 - DNA, 765 bp, Homo sapiens
  Payload ID: 13630
  Gene Symbol: PPP1CA
  Gene Name: protein phosphatase 1, catalytic subunit, alpha isozyme
  ENST ID: ENST00000527663
  CDS Start-End: 7-765
gccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagacc

SEQ ID NO: 170890 - DNA, 588 bp, Homo sapiens
  Payload ID: 13630
  Gene Symbol: PPP1CA
  Gene Name: protein phosphatase 1, catalytic subunit, alpha isozyme
  ENST ID: ENST00000542876
  CDS Start-End: 50-588
cttcttgctgacgccgccagcgccgaccaccagcagctgttttccctccatgaggcagcgcgccgaccgccgaagcatggtctccaccagcggcgccgccaccgcctcgtcggccgccggccccagccgcggcgcggcccacagcccctccagcgcgccgcacgcctccagacacaggccgccgttcagctccagggccactgggcttctccagcagcgccagcactgtgtccaccactgcacccagctctgcccgcgggtgcagacgccatgcctgccgcccccgccagcgccagccactgagcttcacagctacctgcagcaaggaggggaaaggggcctcctggacaccaccccaggtactgcagggtggggcacttccgccacaggagccgtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcc

SEQ ID NO: 170891 - DNA, 554 bp, Homo sapiens
  Payload ID: 13630
  Gene Symbol: PPP1CA
  Gene Name: protein phosphatase 1, catalytic subunit, alpha isozyme
  ENST ID: ENST00000546202
  CDS Start-End: 48-554
tcttgctgacgccgccagcgccgaccaccagcagctgttttccctccatgaggcagcgcgccgaccgccgaagcatggtctccaccagcggcgccgccaccgcctcgtcggccgccggccccagccgcggcgcggcccacagcccctccagcgcgccgcacgcctccagacacaggccgccgttcagctccagggccactgggcttctccagcagcgccagcactgtgtccaccactgcacccagctctgcccgcgggtgcagacgccatgcctgccgcccccgccagcgccagccactgagcttcacagctacctgcagcaaggaggggaaaggggcctcctggacaccaccccagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgag

SEQ ID NO: 170892 - DNA, 3527 bp, Homo sapiens
  Payload ID: 13631
  Gene Symbol: PPP1CB
  Gene Name: protein phosphatase 1, catalytic subunit, beta isozyme
  Uniprot ID: P62140
  ENST ID: ENST00000296122
  CDS Start-End: 199-1182
ggcgctggtgagctttgcggagctgggcggtgccgaggaggaggaggtggcggcctgggtctgacgcggccctgttcgagggggcctctcttgtttatttatttattttccgtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttagga

SEQ ID NO: 170893 - DNA, 4771 bp, Homo sapiens
  Payload ID: 13631
  Gene Symbol: PPP1CB
  Gene Name: protein phosphatase 1, catalytic subunit, beta isozyme
  Uniprot ID: P62140
  ENST ID: ENST00000358506
  CDS Start-End: 161-1144
gctgcgtgacgcggcggcgcgcaagggacgtgcggagtgagtggcgctgcgggtggggccgtcggcggcgctggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatataagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttattttt

SEQ ID NO: 170894 - DNA, 4893 bp, Homo sapiens
  Payload ID: 13631
  Gene Symbol: PPP1CB
  Gene Name: protein phosphatase 1, catalytic subunit, beta isozyme
  Uniprot ID: P62140
  ENST ID: ENST00000395366
  CDS Start-End: 273-1256
ggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatataagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatga

SEQ ID NO: 170895 - DNA, 281 bp, Homo sapiens
  Payload ID: 13631
  Gene Symbol: PPP1CB
  Gene Name: protein phosphatase 1, catalytic subunit, beta isozyme
  ENST ID: ENST00000418910
  CDS Start-End: 1-249
tgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggtagactagtaaatttgccttacagattttttttttcttctattattcggaaaatacctataataatcaagaggctgtgggaaaacaaagcagtgcttgtatgaaaactcaagtgattaaaactgttttaaacatg

SEQ ID NO: 170896 - DNA, 721 bp, Homo sapiens
  Payload ID: 13631
  Gene Symbol: PPP1CB
  Gene Name: protein phosphatase 1, catalytic subunit, beta isozyme
  ENST ID: ENST00000455580
  CDS Start-End: 214-721
cacctgcgcgaagacggcagcgggagaagccgctccagtgcggttgcgcggcggcccaggcgtcgaggggagcctcggcggggagcgcaccgcgcgcctgcgcggagagctgcgtgacgcggcggcgcgcaagggacgtgcggagtgagtggcgctgcgggtggggccgtcggcggcgctgtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacag

SEQ ID NO: 170897 - DNA, 569 bp, Homo sapiens
  Payload ID: 13631
  Gene Symbol: PPP1CB
  Gene Name: protein phosphatase 1, catalytic subunit, beta isozyme
  ENST ID: ENST00000427786
  CDS Start-End: 108-302
gagctgcgtgacgcggcggcgcgcaagggacgtgcggagtgagtggcgctgcgggtggggccgtcggcggcgctgtacgaggatgtcgtccaggaaagattgtgcagatgactgaagcagaagttcgaggcttatgtatcaagtctcgggagatctttctcagccagcctattcttttggaattggaagcaccgctgaaaatttgtggaattcaggaacagcttagtgggtcctctggctctgggtctctcacaaggctccaattaaggcgtgatctcgggctgcagtcatctgaaggttgaactgtgaaaggattcagttccttatagactgatggactaagagcctcagttccaaatgagctgttggtcagaggcctccctcagttctttgctacgtgggatgcttcattagacagctggtttcatcagcgagcatggaagaaggagatattcatggacaatatacagatttactgagattatttgaatatggaggtttcccaccagaagccaactatcttttcttaggagattatgtggacagaggaaagcagtctttggaaacca

SEQ ID NO: 170898 - DNA, 570 bp, Homo sapiens
  Payload ID: 13631
  Gene Symbol: PPP1CB
  Gene Name: protein phosphatase 1, catalytic subunit, beta isozyme
  ENST ID: ENST00000420282
  CDS Start-End: 196-570
agtgcggttgcgcggcggcccaggcgtcgaggggagcctcggcggggagcgcaccgcgcgcctgcgcggagagctgcgtgacgcggcggcgcgcaagggacgtgcggagtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgag

SEQ ID NO: 170899 - DNA, 584 bp, Homo sapiens
  Payload ID: 13631
  Gene Symbol: PPP1CB
  Gene Name: protein phosphatase 1, catalytic subunit, beta isozyme
  ENST ID: ENST00000441461
  CDS Start-End: 170-584
gcgcggagagctgcgtgacgcggcggcgcgcaagggacgtgcggagtgagtggcgctgcgggtggggccgtcggcggcgctggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaat

SEQ ID NO: 170900 - DNA, 2559 bp, Homo sapiens
  Payload ID: 13632
  Gene Symbol: PPP1CC
  Gene Name: protein phosphatase 1, catalytic subunit, gamma isozyme
  Uniprot ID: P36873
  ENST ID: ENST00000335007
  CDS Start-End: 192-1163
ttttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaaccacacggttgcattttggttttgcttctttcaaatagtctgttttccaaagatggattataatacagatactaatactctttgagttgtaacctggagacatctatttgtgtaatagagtgatgaggtggaac

SEQ ID NO: 170901 - DNA, 1472 bp, Homo sapiens
  Payload ID: 13632
  Gene Symbol: PPP1CC
  Gene Name: protein phosphatase 1, catalytic subunit, gamma isozyme
  Uniprot ID: P36873
  ENST ID: ENST00000340766
  CDS Start-End: 233-1246
atccgtgcgccgcccgaggctgtctaaggagtcggcggccattttgttcttctcgtggttccagtggggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaagggttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgtt

SEQ ID NO: 170902 - DNA, 563 bp, Homo sapiens
  Payload ID: 13632
  Gene Symbol: PPP1CC
  Gene Name: protein phosphatase 1, catalytic subunit, gamma isozyme
  ENST ID: ENST00000551582
  CDS Start-End: 1-252
aactgtttaccgatagcagccatcgtggatgagaagatattctgctgtcatggaggtttatcaccagatcttcaatctatggagcagattcggcgaattatgcgaccaactgatgtaccagatcaagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgct

SEQ ID NO: 170903 - DNA, 2154 bp, Homo sapiens
  Payload ID: 13632
  Gene Symbol: PPP1CC
  Gene Name: protein phosphatase 1, catalytic subunit, gamma isozyme
  ENST ID: ENST00000546933
  CDS Start-End: 1001-1999
atcagaacgagacttagttacatattttggggtccaaaagtgaactttataactgtaaaattaaggtacatttagcagttccgtgctactttatctgtatctaatgactatccagtctgttacaactggaaccaaaacaaaatttctttcccacaactacctacgtgctgacaagtgagttctgttgcaaagtttgtactttgatagaagaaccctaagtgctctggtggtgtggatgccccatgctgtgcaatgatttctttctcccattattatcttatctgttcaaattattagggaacgtgctttcttacagtatagcacatgactgacatcctttgccctatatagacatgagcataaacacaaatgcaggcccagaaaatgcatggcaaaataagtacaatgaaccaacattttcttaatgaaatgaaaacaacactaacattttttcataggtaaattaaatcagagatcctcaggaggagatacccatggtcctctggaaaacactgatgggggagggttctgagtatttccaatcctgtttcttttcttttcttttctttccttttcttttttttttttgagacggagtctcgctgtgttgccaggctggagtgcagtggcgcgatcttggctcactgcaacctccgcctcccgggtgcaggcgattctcctgagtagctgggattacaggtgcacgccatgttggcgaggatggtctggatctcttgacctcatcatgatctgcccgcctcaccctcccaaagtgctgggattacaagcgtgagccattgcatctggcctgcagtcctgtttctaacagcattcgcacagacaggatggctccttttttggaatactataaaagaagtcttacttggtatcgaagatgcaattaagtcttgtctaagattttaagattctaattagacattaaaaccatgtttattataagtgtcctgaaaatgaagccactcagaaagctagttaaaccatgtttttgcccctttatctaaatctcgtattgtattttgtattttggcttcattggactaattgcgatttttctcttgcagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctgg

SEQ ID NO: 170904 - DNA, 747 bp, Homo sapiens
  Payload ID: 13632
  Gene Symbol: PPP1CC
  Gene Name: protein phosphatase 1, catalytic subunit, gamma isozyme
  ENST ID: ENST00000550261
  CDS Start-End: 1-163
catccatggacaatactatgatttgctgcgactttttgagtacggtggtttcccaccagaaagcaactacctgtttcttggggactatgtggacaggggaaagcagtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaagggttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaa

SEQ ID NO: 170905 - DNA, 1581 bp, Homo sapiens
  Payload ID: 13632
  Gene Symbol: PPP1CC
  Gene Name: protein phosphatase 1, catalytic subunit, gamma isozyme
  ENST ID: ENST00000551676
  CDS Start-End: 133-945
ggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtattgattttgaattttacatgtacacttaagagcatgtgtgtgagcacagattctccttgttgattttggtgggtaggtattgcttatttatacaaagtgtttctggaacacaagatatcaggctcaatgggaaactgaaacatggttttactcacctaatatttgcacctatttatattgaaaaaattttctcttcaaggtggttgaagatggatatgaattttttgcaaagaggcagttggtcactctgttttctgcgcccaattattgcggagagtttgacaatgcaggtgccatgatgagtgtggatgaaacactaatgtgttcttttcaggtagagcatgctttcaacatgatttccttttaatatgtttacactttgctgattgaaaaatataattgctactttttgcctagtgttcacttatgctgagtaggctaagtttttattttcccttaaccagtgtgtattatagttgaataatgtgtggatcccttgtaaaagaaaaaattaattatggcaccttttcccagtgttgaattataaatttttgcattgcatattggctccttaatgcttatggctcttttactgtaaatctaaaaccttaatgacaatgtaatgttcagctaaaattaaatcaccacttgaatgtgaaaagtactgagtgccttgtgctatgtgtttacttagttctg

SEQ ID NO: 170906 - DNA, 1882 bp, Homo sapiens
  Payload ID: 13632
  Gene Symbol: PPP1CC
  Gene Name: protein phosphatase 1, catalytic subunit, gamma isozyme
  ENST ID: ENST00000550991
  CDS Start-End: 167-1081
gggagagaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcaggtagagcatgctttcaacatgatttccttttaatatgtttacactttgctgattgaaaaatataattgctactttttgcctagtgttcacttatgctgagtaggctaagtttttattttcccttaaccagtgtgtattatagttgaataatgtgtggatcccttgtaaaagaaaaaattaattatggcaccttttcccagtgttgaattataaatttttgcattgcatattggctccttaatgcttatggctcttttactgtaaatctaaaaccttaatgacaatgtaatgttcagctaaaattaaatcaccacttgaatgtgaaaagtactgagtgccttgtgctatgtgtttacttagttctgccctctagtctaacttccacaaaacttctgttaatgtaccatgacatcatttggccttcagttggcacaaaagcattatttagaatctgcctcagcctttttctcatttgcttattatgatacttgtacaacttcaagccagcctagtcataaacataaatacagccaccaaatcatgtggcactcatcagttaaatgaattaaaatagttttttaccaattatcagagagaacttgcagctttcaaaattccaaagattgtgcaaggatcccctacaggttggagaaacacttttgtaaagaactttttcccctgtatcagaaggagtagctaaagatactaccaggtgtagacttcagaagattgtcattatactcagaggcaaaataatttgtccagataatagattttatctgttcgtcatagcgttaattaccaaatgtttacattcaacatagcttgtgttaa

SEQ ID NO: 170907 - DNA, 582 bp, Homo sapiens
  Payload ID: 13632
  Gene Symbol: PPP1CC
  Gene Name: protein phosphatase 1, catalytic subunit, gamma isozyme
  ENST ID: ENST00000620030
  CDS Start-End: 161-582
gaaggaggaagtagggagcggggtggcaggggggggacccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaa

SEQ ID NO: 170908 - DNA, 1723 bp, Homo sapiens
  Payload ID: 13633
  Gene Symbol: PPP1R11
  Gene Name: protein phosphatase 1, regulatory (inhibitor) subunit 11
  ENST ID: ENST00000376758
  CDS Start-End: 472-696
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 170909 - DNA, 1464 bp, Homo sapiens
  Payload ID: 13633
  Gene Symbol: PPP1R11
  Gene Name: protein phosphatase 1, regulatory (inhibitor) subunit 11
  ENST ID: ENST00000376763
  CDS Start-End: 213-437
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 170910 - DNA, 1536 bp, Homo sapiens
  Payload ID: 13633
  Gene Symbol: PPP1R11
  Gene Name: protein phosphatase 1, regulatory (inhibitor) subunit 11
  ENST ID: ENST00000376765
  CDS Start-End: 285-509
ggattagaagagttgttggaggagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 170911 - DNA, 1689 bp, Homo sapiens
  Payload ID: 13633
  Gene Symbol: PPP1R11
  Gene Name: protein phosphatase 1, regulatory (inhibitor) subunit 11
  ENST ID: ENST00000376769
  CDS Start-End: 438-662
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 170912 - DNA, 1731 bp, Homo sapiens
  Payload ID: 13633
  Gene Symbol: PPP1R11
  Gene Name: protein phosphatase 1, regulatory (inhibitor) subunit 11
  Uniprot ID: O60927
  ENST ID: ENST00000376772
  CDS Start-End: 324-704
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 170913 - DNA, 1640 bp, Homo sapiens
  Payload ID: 13633
  Gene Symbol: PPP1R11
  Gene Name: protein phosphatase 1, regulatory (inhibitor) subunit 11
  ENST ID: ENST00000376773
  CDS Start-End: 389-613
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 170914 - DNA, 1731 bp, Homo sapiens
  Payload ID: 13633
  Gene Symbol: PPP1R11
  Gene Name: protein phosphatase 1, regulatory (inhibitor) subunit 11
  Uniprot ID: O60927
  ENST ID: ENST00000383612
  CDS Start-End: 324-704
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170915 - DNA, 1723 bp, Homo sapiens
  Payload ID: 13633
  Gene Symbol: PPP1R11
  Gene Name: protein phosphatase 1, regulatory (inhibitor) subunit 11
  ENST ID: ENST00000400654
  CDS Start-End: 472-696
ggaaaaaggaagggagatcaaagattaggtgctggggactgaaaaataattttcatgtattaatactaccaaggatgatttggggaggaagacggagaaaaagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactggttgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170916 - DNA, 1464 bp, Homo sapiens
  Payload ID: 13633
  Gene Symbol: PPP1R11
  Gene Name: protein phosphatase 1, regulatory (inhibitor) subunit 11
  ENST ID: ENST00000400655
  CDS Start-End: 213-437
gggatatgggaggtgtggggttgaatatctagggctgggagaatcggaaggatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170917 - DNA, 1539 bp, Homo sapiens
  Payload ID: 13633
  Gene Symbol: PPP1R11
  Gene Name: protein phosphatase 1, regulatory (inhibitor) subunit 11
  ENST ID: ENST00000400656
  CDS Start-End: 288-512
cagggattagaagagttgttggaggagctaggcctagggatatgggaggtgtggggttgaatatctagggctgggagaatcggaaggtattggagctatttggagtggcagagatggtgcaggaggatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170918 - DNA, 1689 bp, Homo sapiens
  Payload ID: 13633
  Gene Symbol: PPP1R11
  Gene Name: protein phosphatase 1, regulatory (inhibitor) subunit 11
  ENST ID: ENST00000400657
  CDS Start-End: 438-662
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170919 - DNA, 1640 bp, Homo sapiens
  Payload ID: 13633
  Gene Symbol: PPP1R11
  Gene Name: protein phosphatase 1, regulatory (inhibitor) subunit 11
  ENST ID: ENST00000400658
  CDS Start-End: 389-613
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170920 - DNA, 1723 bp, Homo sapiens
  Payload ID: 13633
  Gene Symbol: PPP1R11
  Gene Name: protein phosphatase 1, regulatory (inhibitor) subunit 11
  ENST ID: ENST00000455887
  CDS Start-End: 472-696
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170921 - DNA, 1536 bp, Homo sapiens
  Payload ID: 13633
  Gene Symbol: PPP1R11
  Gene Name: protein phosphatase 1, regulatory (inhibitor) subunit 11
  ENST ID: ENST00000444994
  CDS Start-End: 285-509
ggattagaagagttgttggaggagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170922 - DNA, 1689 bp, Homo sapiens
  Payload ID: 13633
  Gene Symbol: PPP1R11
  Gene Name: protein phosphatase 1, regulatory (inhibitor) subunit 11
  ENST ID: ENST00000429382
  CDS Start-End: 438-662
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170923 - DNA, 1640 bp, Homo sapiens
  Payload ID: 13633
  Gene Symbol: PPP1R11
  Gene Name: protein phosphatase 1, regulatory (inhibitor) subunit 11
  ENST ID: ENST00000430828
  CDS Start-End: 389-613
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170924 - DNA, 1640 bp, Homo sapiens; identical to SEQ ID NO: 170923
  Payload ID: 13633
  Gene Symbol: PPP1R11
  Gene Name: protein phosphatase 1, regulatory (inhibitor) subunit 11
  ENST ID: ENST00000441553
  CDS Start-End: 389-613

SEQ ID NO: 170925 - DNA, 1723 bp, Homo sapiens
  Payload ID: 13633
  Gene Symbol: PPP1R11
  Gene Name: protein phosphatase 1, regulatory (inhibitor) subunit 11
  ENST ID: ENST00000452227
  CDS Start-End: 472-696
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170926 - DNA, 1731 bp, Homo sapiens
  Payload ID: 13633
  Gene Symbol: PPP1R11
  Gene Name: protein phosphatase 1, regulatory (inhibitor) subunit 11
  Uniprot ID: O60927
  ENST ID: ENST00000437937
  CDS Start-End: 324-704
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170927 - DNA, 1464 bp, Homo sapiens
  Payload ID: 13633
  Gene Symbol: PPP1R11
  Gene Name: protein phosphatase 1, regulatory (inhibitor) subunit 11
  ENST ID: ENST00000444101
  CDS Start-End: 213-437
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170928 - DNA, 1640 bp, Homo sapiens; identical to SEQ ID NO: 170923
  Payload ID: 13633
  Gene Symbol: PPP1R11
  Gene Name: protein phosphatase 1, regulatory (inhibitor) subunit 11
  ENST ID: ENST00000455350
  CDS Start-End: 389-613

SEQ ID NO: 170929 - DNA, 1689 bp, Homo sapiens
  Payload ID: 13633
  Gene Symbol: PPP1R11
  Gene Name: protein phosphatase 1, regulatory (inhibitor) subunit 11
  ENST ID: ENST00000449087
  CDS Start-End: 438-662
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170930 - DNA, 1723 bp, Homo sapiens; identical to SEQ ID NO: 170925
  Payload ID: 13633
  Gene Symbol: PPP1R11
  Gene Name: protein phosphatase 1, regulatory (inhibitor) subunit 11
  ENST ID: ENST00000450177
  CDS Start-End: 472-696

SEQ ID NO: 170931 - DNA, 1640 bp, Homo sapiens; identical to SEQ ID NO: 170923
  Payload ID: 13633
  Gene Symbol: PPP1R11
  Gene Name: protein phosphatase 1, regulatory (inhibitor) subunit 11
  ENST ID: ENST00000433942
  CDS Start-End: 389-613

SEQ ID NO: 170932 - DNA, 1723 bp, Homo sapiens; identical to SEQ ID NO: 170925
  Payload ID: 13633
  Gene Symbol: PPP1R11
  Gene Name: protein phosphatase 1, regulatory (inhibitor) subunit 11
  ENST ID: ENST00000430959
  CDS Start-End: 472-696

SEQ ID NO: 170933 - DNA, 1464 bp, Homo sapiens; identical to SEQ ID NO: 170927
  Payload ID: 13633
  Gene Symbol: PPP1R11
  Gene Name: protein phosphatase 1, regulatory (inhibitor) subunit 11
  ENST ID: ENST00000434591
  CDS Start-End: 213-437

SEQ ID NO: 170934 - DNA, 1536 bp, Homo sapiens; identical to SEQ ID NO: 170921
  Payload ID: 13633
  Gene Symbol: PPP1R11
  Gene Name: protein phosphatase 1, regulatory (inhibitor) subunit 11
  ENST ID: ENST00000436833
  CDS Start-End: 285-509

SEQ ID NO: 170935 - DNA, 1689 bp, Homo sapiens; identical to SEQ ID NO: 170922
  Payload ID: 13633
  Gene Symbol: PPP1R11
  Gene Name: protein phosphatase 1, regulatory (inhibitor) subunit 11
  ENST ID: ENST00000446310
  CDS Start-End: 438-662

SEQ ID NO: 170936 - DNA, 1464 bp, Homo sapiens; identical to SEQ ID NO: 170927
  Payload ID: 13633
  Gene Symbol: PPP1R11
  Gene Name: protein phosphatase 1, regulatory (inhibitor) subunit 11
  ENST ID: ENST00000412077
  CDS Start-End: 213-437

SEQ ID NO: 170937 - DNA, 1731 bp, Homo sapiens; identical to SEQ ID NO: 170926
  Payload ID: 13633
  Gene Symbol: PPP1R11
  Gene Name: protein phosphatase 1, regulatory (inhibitor) subunit 11
  Uniprot ID: O60927
  ENST ID: ENST00000448378
  CDS Start-End: 324-704

SEQ ID NO: 170938 - DNA, 1464 bp, Homo sapiens
  Payload ID: 13633
  Gene Symbol: PPP1R11
  Gene Name: protein phosphatase 1, regulatory (inhibitor) subunit 11
  ENST ID: ENST00000458506
  CDS Start-End: 213-437
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170939 - DNA, 1640 bp, Homo sapiens
  Payload ID: 13633
  Gene Symbol: PPP1R11
  Gene Name: protein phosphatase 1, regulatory (inhibitor) subunit 11
  ENST ID: ENST00000437171
  CDS Start-End: 389-613
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170940 - DNA, 1536 bp, Homo sapiens; identical to SEQ ID NO: 170921
  Payload ID: 13633
  Gene Symbol: PPP1R11
  Gene Name: protein phosphatase 1, regulatory (inhibitor) subunit 11
  ENST ID: ENST00000414618
  CDS Start-End: 285-509

SEQ ID NO: 170941 - DNA, 1723 bp, Homo sapiens; identical to SEQ ID NO: 170925
  Payload ID: 13633
  Gene Symbol: PPP1R11
  Gene Name: protein phosphatase 1, regulatory (inhibitor) subunit 11
  ENST ID: ENST00000422273
  CDS Start-End: 472-696

SEQ ID NO: 170942 - DNA, 1464 bp, Homo sapiens; identical to SEQ ID NO: 170927
  Payload ID: 13633
  Gene Symbol: PPP1R11
  Gene Name: protein phosphatase 1, regulatory (inhibitor) subunit 11
  ENST ID: ENST00000428563
  CDS Start-End: 213-437

SEQ ID NO: 170943 - DNA, 1607 bp, Homo sapiens
  Payload ID: 13633
  Gene Symbol: PPP1R11
  Gene Name: protein phosphatase 1, regulatory (inhibitor) subunit 11
  Uniprot ID: O60927
  ENST ID: ENST00000431977
  CDS Start-End: 200-580
cggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170944 - DNA, 1689 bp, Homo sapiens
  Payload ID: 13633
  Gene Symbol: PPP1R11
  Gene Name: protein phosphatase 1, regulatory (inhibitor) subunit 11
  ENST ID: ENST00000414032
  CDS Start-End: 438-662
ccggaagcggcgagccggaagtggggttagccaggttatccccaggggtggagaagcggaggcccaggaggagggggaataaagaaggtggaggatcctggctaccaatctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170945 - DNA, 1723 bp, Homo sapiens; identical to SEQ ID NO: 170925
  Payload ID: 13633
  Gene Symbol: PPP1R11
  Gene Name: protein phosphatase 1, regulatory (inhibitor) subunit 11
  ENST ID: ENST00000449435
  CDS Start-End: 472-696

SEQ ID NO: 170946 - DNA, 1536 bp, Homo sapiens
  Payload ID: 13633
  Gene Symbol: PPP1R11
  Gene Name: protein phosphatase 1, regulatory (inhibitor) subunit 11
  ENST ID: ENST00000433662
  CDS Start-End: 285-509
ggattagaagagttgttggagaagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170947 - DNA, 1614 bp, Homo sapiens
  Payload ID: 13633
  Gene Symbol: PPP1R11
  Gene Name: protein phosphatase 1, regulatory (inhibitor) subunit 11
  Uniprot ID: O60927
  ENST ID: ENST00000431424
  CDS Start-End: 207-587
ccggaagcggcgagccggaagtggggttagccaggttatccccaggggtggagaagcggaggcccaggaggagggggaataaagaaggtggaggatcctggctaccaatctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 170948 - DNA, 1640 bp, Homo sapiens; identical to SEQ ID NO: 170923
  Payload ID: 13633
  Gene Symbol: PPP1R11
  Gene Name: protein phosphatase 1, regulatory (inhibitor) subunit 11
  ENST ID: ENST00000448550
  CDS Start-End: 389-613

SEQ ID NO: 170949 - DNA, 1536 bp, Homo sapiens; identical to SEQ ID NO: 170921
  Payload ID: 13633
  Gene Symbol: PPP1R11
  Gene Name: protein phosphatase 1, regulatory (inhibitor) subunit 11
  ENST ID: ENST00000418211
  CDS Start-End: 285-509

SEQ ID NO: 170950 - DNA, 1731 bp, Homo sapiens; identical to SEQ ID NO: 170926
  Payload ID: 13633
  Gene Symbol: PPP1R11
  Gene Name: protein phosphatase 1, regulatory (inhibitor) subunit 11
  Uniprot ID: O60927
  ENST ID: ENST00000452679
  CDS Start-End: 324-704

SEQ ID NO: 170951 - DNA, 1689 bp, Homo sapiens; identical to SEQ ID NO: 170922
  Payload ID: 13633
  Gene Symbol: PPP1R11
  Gene Name: protein phosphatase 1, regulatory (inhibitor) subunit 11
  ENST ID: ENST00000417223
  CDS Start-End: 438-662

SEQ ID NO: 170952 - DNA, 1689 bp, Homo sapiens; identical to SEQ ID NO: 170922
  Payload ID: 13633
  Gene Symbol: PPP1R11
  Gene Name: protein phosphatase 1, regulatory (inhibitor) subunit 11
  ENST ID: ENST00000448210
  CDS Start-End: 438-662

SEQ ID NO: 170953 - DNA, 1731 bp, Homo sapiens; identical to SEQ ID NO: 170926
  Payload ID: 13633
  Gene Symbol: PPP1R11
  Gene Name: protein phosphatase 1, regulatory (inhibitor) subunit 11
  Uniprot ID: O60927
  ENST ID: ENST00000436591
  CDS Start-End: 324-704

SEQ ID NO: 170954 - DNA, 1464 bp, Homo sapiens; identical to SEQ ID NO: 170927
  Payload ID: 13633
  Gene Symbol: PPP1R11
  Gene Name: protein phosphatase 1, regulatory (inhibitor) subunit 11
  ENST ID: ENST00000451993
  CDS Start-End: 213-437

SEQ ID NO: 170955 - DNA, 1536 bp, Homo sapiens; identical to SEQ ID NO: 170921
  Payload ID: 13633
  Gene Symbol: PPP1R11
  Gene Name: protein phosphatase 1, regulatory (inhibitor) subunit 11
  ENST ID: ENST00000439463
  CDS Start-End: 285-509

SEQ ID NO: 170956 - DNA, 777 bp, Homo sapiens
  Payload ID: 13634
  Gene Symbol: PPP1R14A
  Gene Name: protein phosphatase 1, regulatory (inhibitor) subunit 14A
  Uniprot ID: Q96A00
  ENST ID: ENST00000301242
  CDS Start-End: 253-696
gcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 170957 - DNA, 637 bp, Homo sapiens
  Payload ID: 13634
  Gene Symbol: PPP1R14A
  Gene Name: protein phosphatase 1, regulatory (inhibitor) subunit 14A
  Uniprot ID: Q96A00
  ENST ID: ENST00000347262
  CDS Start-End: 194-556
gcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatgggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 170958 - DNA, 949 bp, Homo sapiens
  Payload ID: 13634
  Gene Symbol: PPP1R14A
  Gene Name: protein phosphatase 1, regulatory (inhibitor) subunit 14A
  ENST ID: ENST00000591585
  CDS Start-End: 194-559
gcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggtgagttttctctccctcattctctccctgttctggccccaagtactctgatgggggagggggaagaagctggcagaagggtctctggggaacaccacccggccccaccacccccggccccaacctgccctccgcagctctttctggtctccaggggtgtcttttgtcctcctacttgtctctctccctctctcccccatctgctgagggggctccattctgtcctcccccatctgccctgtttttgcctctcctgtgcctgtcctttggccaccagccttcgggctcagtctccctctgtcctcccctgtcactgcctccgccaccccgggctcccttccccacctctgggggccctccatcctcccaggccctgaagctgagcggcccaacccctcccacttccttccctgctttaaaagggaaaactattcatgtttc

SEQ ID NO: 170959 - DNA, 607 bp, Homo sapiens
  Payload ID: 13634
  Gene Symbol: PPP1R14A
  Gene Name: protein phosphatase 1, regulatory (inhibitor) subunit 14A
  ENST ID: ENST00000587515
  CDS Start-End: 293-526
ctagagccaaggcgagagacccgtgccagccccgaggctcccggggcccatgggcccaggcatcgggctggtacagggccccggggctctctcagcccatctgtcacccctcccccccaacacccagatgtcccgtcttggcagtgctgtcccggactgccacattaatgctccagaacccgccagctgggccctggggccggtggggctcctgcagagccctggacaaaggcgagggagggagggaaggggatcctaagcacccctccctccctggccctaggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 170960 - DNA, 433 bp, Homo sapiens
  Payload ID: 13634
  Gene Symbol: PPP1R14A
  Gene Name: protein phosphatase 1, regulatory (inhibitor) subunit 14A
  ENST ID: ENST00000591291
  CDS Start-End: 34-405
acagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagccccctccaggaccgggcccggactgctcacccctgaccctcttgcactctccctgccccccggacgccgcccagcttgcttgtgtataagttgtatttaatggttctgtaacaataa

SEQ ID NO: 170961 - DNA, 982 bp, Homo sapiens
  Payload ID: 13635
  Gene Symbol: PPP1R14B
  Gene Name: protein phosphatase 1, regulatory (inhibitor) subunit 14B
  Uniprot ID: Q96C90
  ENST ID: ENST00000309318
  CDS Start-End: 269-712
gacagagaaagcgcttcggcggctgcagctcgggcggcggccgcgggggacaaagggcgggcggatcggcggggagggggcggggcgcggccaggccaagcccgggggctccgcatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgacggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgca

SEQ ID NO: 170962 - DNA, 920 bp, Homo sapiens
  Payload ID: 13635
  Gene Symbol: PPP1R14B
  Gene Name: protein phosphatase 1, regulatory (inhibitor) subunit 14B
  ENST ID: ENST00000542235
  CDS Start-End: 497-715
gggcttcctggggagggtgtggcagggtggtgggcatcccctccctcaccaaagcatgggctctttgtttcctctttgccaggcctgggtccttcccagtgacccctcagccttcacttcctcctcactcccggggagctgtgacaggtgtttgggggaggggaggggggtatgataagctgggacagctgcacccaccggtgctctggtgagatggggggcccggatgttggggagacacatctgctgggttcccagcccaaggtccccaaccctggctgtctggccttgtctgtcaccccccgtgcccactggcagggacaggaagctcccccccccaccccgctttgggcagtttgccttggcacgggcctgatctgttttcctccccagagcagctgctgttctgtctgctgggcagagggctgggttcctccgaggtaggcaggggcctcaacccagagcccctctcacaccctctctccaactcaggcttatgtctctccctcctcccccacccccaccccaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgacggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggacttt

SEQ ID NO: 170963 - DNA, 600 bp, Homo sapiens
  Payload ID: 13635
  Gene Symbol: PPP1R14B
  Gene Name: protein phosphatase 1, regulatory (inhibitor) subunit 14B
  ENST ID: ENST00000392210
  CDS Start-End: 189-326
ccccaggtcaagcctagtgtcctccagacgcctcaaggggtagcctgagccttgggcaagaggcaagggggctatcctgggctggcagcggcaggaggtctcaccgcctggtgcccgctgggttagactgtggttacaaggaagaggagatcccagaactggagattgacgtggatgagctcctggacatggagagtgacgatgcccgggctgccagggtcaaggagctgctggttgactgttacaaacccacagaggccttcatttctggcctgctggacaagatccggggcatgcagaagctgagcacaccccagaagaagtgacggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgcagcta

SEQ ID NO: 170964 - DNA, 2152 bp, Homo sapiens
  Payload ID: 13636
  Gene Symbol: PPP1R14C
  Gene Name: protein phosphatase 1, regulatory (inhibitor) subunit 14C
  Uniprot ID: Q8TAE6
  ENST ID: ENST00000361131
  CDS Start-End: 118-615
agagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgagacggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaagaagaaatgccagaggtagaaattgacattgatgatcttcttgatgcagacagtgatgaagagagagcttcaaaattacaggaagctcttgtagactgctacaaaccaacagaggaatttatcaaagagctgctttctcggataagaggcatgaggaaactgagccctccgcagaagaagagtgtatgattctggaacagggtgaaactctcccagagacgaagaaagagtcctgggatttgtacttcatgaagacttttgtgaaagaataggtgtccttatgaacaacgtttttgtttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtacatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaa

SEQ ID NO: 170965 - DNA, 757 bp, Homo sapiens
  Payload ID: 13637
  Gene Symbol: PPP1R14D
  Gene Name: protein phosphatase 1, regulatory (inhibitor) subunit 14D
  Uniprot ID: Q9NXH3
  ENST ID: ENST00000299174
  CDS Start-End: 69-506
cacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccggggccagctccagcgctggctggagatggagcaatgggtggatgctcaagttcaggagctcttccaggatcaagcaaccccttctgagcctgagattgacctggaagctctcatggatctatccacagaggagcagaagactcagctggaggccattcttgggaactgcccccgccccacagaggcttttatctctgagctgctcagtcaactcaagaaactccggagactcagccggcctcagaaataagcctgagagaccatctttagcagcctcagcactgccaggcctgccctgaaactccagatcctggctaagagggaaatagctccttgggacacaaacaagaaatgtggacaaggagggacatttgcatactcctactgtctgtgtggtcacagctagtttctgtcagctgggctctctgggagaaagctggctgttgtccaatgccttccttggcagccaagtggataaaacctttaggagccccagctcaa

SEQ ID NO: 170966 - DNA, 747 bp, Homo sapiens
  Payload ID: 13637
  Gene Symbol: PPP1R14D
  Gene Name: protein phosphatase 1, regulatory (inhibitor) subunit 14D
  ENST ID: ENST00000427255
  CDS Start-End: 69-671
cacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccggggccagctccagcgctggctggagatggagcaatgggtggatgctcaagttcaggagctcttccagagtcttgctctgtcacccaggctggagtgcagtggtgtgatccattctctgcaacttctgcctcccgggttcaatcgattctcctgcctcagctcctggagtagctgggattacgggatcaagcaaccccttctgagcctgagattgacctggaagctctcatggatctatccacagaggagcagaagactcagctggaggccattcttgggaactgcccccgccccacagaggcttttatctctgagctgctcagtcaactcaagaaactccggagactcagccggcctcagaaataagcctgagagaccatctttagcagcctcagcactgccaggcctgccctgaaactccagatcctggctaagagggaaatagctccttgggacacaaacaagaaatgtggacaaggagggacatttgc

SEQ ID NO: 170967 - DNA, 1826 bp, Homo sapiens
  Payload ID: 13638
  Gene Symbol: PPP1R1A
  Gene Name: protein phosphatase 1, regulatory (inhibitor) subunit 1A
  Uniprot ID: Q13522
  ENST ID: ENST00000257905
  CDS Start-End: 172-687
agagtccccggagccgcgagctgggagcgctgtgccgggagccgggagccgagcgcgccgggctggggccggggccggagcggagcggagagggagcgcgcccgccccagccccgagtcccgccgccttccctcccgccgcagcgcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagtccactttggcaatgtctccacggcaacggaagaagatgacaaggatcacacccacaatgaaagagctccagatgatggttgaacatcacctggggcaacagcagcaaggagaggaacctgagggggccgctgagagcacaggaacccaggagtcccgcccacctgggatcccagacacagaagtggagtcaaggctgggcacctctgggacagcaaaaaaaactgcagaatgcatccctaaaactcacgagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtccttggcactttccttcttttccaactgggagaatcctttctccctgccttcttgccctgccctctctgtagcccccaccctcctgccaagctgcctctgggaaggaagaaacaggagctaggcagaagccttgagcagggaagagttcttcccttagccctgactttacttgctgtgggaagagagatgagggtcagataggtgggaggactaacttccagggtgccaagaaggaagaaaagccccaggttctcttttcttattgaggaacgatccgaccacctcacaggcctgccctgcagctggaagactcggcgctctaaggcctgtgccgtgtccagctgtgactgtgcggtgggctccatctgctggacaaaaggggaactgcaccatggcacttggcccatgggaaagagggtatggtggtgtgccgatacctcctcgcctgccctccaagccccagctgccttccttttggattcccaagcttcaggatgtgttccctcttccagctgtgggaccgctgtcccttatttcaacccgttagcaacaatggatagagaacacagtggctattaatgaagaggcccatgctggagactggaagggttcccttgtcctagacattgaggggcccagataagaccaaaaccaagcataagagaagaaactgtctcagatctcacggccaggcctctctcctgctgctgtttttgattttcccaggtagtgggagagaggaaaggagggaaggcaagattctttccccctccctgctgaagcatgtggtacagaggcaagagcagagcctgagaagcgtcaggtcccacttctgccatgcagctactatgagccctcggggcctcctcctgggcctcagcttgcccagatacatacctaaatatatatatatatatatatgagggagaacgcctcacccagattttatcatgctggaaagagtgtatgtatgtgaagatgcttggtcaacttgtacccagtgaacacaca

SEQ ID NO: 170968 - DNA, 571 bp, Homo sapiens
  Payload ID: 13638
  Gene Symbol: PPP1R1A
  Gene Name: protein phosphatase 1, regulatory (inhibitor) subunit 1A
  ENST ID: ENST00000547826
  CDS Start-End: 28-222
gcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagagctccagatgatggttgaacatcacctggggcaacagcagcaaggagaggaacctgagggggccgctgagagcacaggaacccaggagtcccgcccacctgggatcccagacacagaagtggagtcaaggctgggcacctctgggacagcaaaaaaaactgcagaatgcatccctaaaactcacgagagaggcagtaaggaacccagcacaaaagaaccctcaacccatataccaccactggattccaagggagccaactcgtttgggaatgcatggacaccggatttgtttcttattccttcacttttggggaaaatctcttgtttttaaaaagtgataaatttggtgttaggtccttg

SEQ ID NO: 170969 - DNA, 547 bp, Homo sapiens
  Payload ID: 13638
  Gene Symbol: PPP1R1A
  Gene Name: protein phosphatase 1, regulatory (inhibitor) subunit 1A
  ENST ID: ENST00000553113
  CDS Start-End: 1-272
ggaggcgccgccccacccctgccaccctcgtgctgaccagtgaccagtcatccccagagatagatgaagaccggatccccaacccacatctcaagtccactttggcaatgtctccacggcaacggaagaagatgacaaggatcacacccacaatgaaagaaactgcagaatgcatccctaaaactcacgagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtccttggcactttccttcttttccaactgggagaatcctttctccctgccttcttgccctgccctctctgtagcccccaccctcctgccaagctgcctctgggaaggaagaaacaggagctaggcagaagccttgagcagggaagagtt

SEQ ID NO: 170970 - DNA, 2491 bp, Homo sapiens
  Payload ID: 13638
  Gene Symbol: PPP1R1A
  Gene Name: protein phosphatase 1, regulatory (inhibitor) subunit 1A
  ENST ID: ENST00000547431
  CDS Start-End: 29-490
cgcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagaaactgcagaatgcatccctaaaactcacgagagaggcagtaaggaacccagcacaaaagaaccctcaacccatataccaccactggattccaagggagccaactcggtctgagagaggaggagggactgggggacagaagagcgtgggaggatttccctgctccacccacactttggctccattctatgtcttcactcgctccattttactgctcaaaaggggagagagaatgtcgcatccactggagcccagagacgacccaacaaagatgccatgatagacaccagctctcctacaccctccaccacaacaggctcacctgggccagccccagggctaatccagattcccattctggttgtgttcatcttcggcaggggatgggggggcctcttcttcacagggggacagctcgtcaatggacatctggttggtgatgcctgtagaggagcataaaggaggctgagcttaggccaagaagtattcttccccagaacccaaggagtatgtggagacatgtaagggattctcatccatcaacctgccttcaagctgaactacattcaacccatccccacttgggaagagcctctccagccttgctaaaactcagaaccctcaacaccaccctaccaccccctcacacaggaagagatttcccagccagggccaccaaattagccaaatctacaggggcaccatttacagggaccacagtgtgcacagggacccttgggttgtggaatatctgactgtctctatcatctctacggcccccattcttagaacattccaggccactcagccagtctttcctgtgatctaactggtctgatcagctccactcccaaatcaaggagtccggcaaagggtttccccaggggcttaagaaaaatggacctcctagtgctccatgatccacccacacaagttctcacccctgccctctgccatggtacccaccacttgctgcccgttccttccatttctgcttattctcctgaatgcgcttgacccaggtggaacgaaagctgaccacatcagggttggggtctcccacttccacatccagagagggctggcgccactgaaagctagaagcagaacccccaaaagccgcaagaggtaagccccagcccactccagaaccaccttagccctgggagtgcaggacatggaagaccaggagaaggttcagggaacttcatcttcctcttttcctctactagatattccccaagtccctgtccctctccccctcatttcacccctccctctccacatcttccctcctggtagaaggaaaattaaaacaagattagccagaaggcagaaagacagctaatggaagaaacaaaaatatggtgaaggggagcataggtacaggtcacacccttctgatcccatccttctgtccctgacggcagagggactcccaagcttgaagcagtctgcctccccaccaccccaccatggctgtgagtcggtcctctctgtgagtccaaatccctccctaccactgccttcctgaaccaagatatctggctaccccagccaccctcacctgggctggtttttagacttggagtcctcatccgccaggggctgaacactcttctctgccacgtcagtcagcacagagaatgtgggctccacaatgaagtcgatgaaccctgcagtggaggagcaatgccgtagagatgtcttactattatctggagggctaggcagagcatgcagctggcatggccaggacccctggctgcttatgaaagaggatggagaggtaacctggggctgaaaacttcccaatgcagggcaggctttgggatgatgtcttggtgccccagagagctccttcctgccattgcagccccctggcctcctaacccaggaccccatgctctagcacagtaggctttcctctacaggaagaatggtttggggggattgaggacttggagcaatcctgacccaggcagcatcttttccccctcccagtcctccccttcctgcaggagaggacactcacctatctgagactgtgccactagagtggaagtgcggtcacagagtggagaaaagggcaggcccaactctgcctccttgtcaccctagaggagggaacagggtaggaaagctggagaggatacctcagacctaccagatctggggtacaggtggcaagtggtgggggtggggggttgttgtgtgaaatttctgcactgttgacctggaaattagtaatatgcaaatgaaatatatgcaaatgaaatgc

SEQ ID NO: 170971 - DNA, 1845 bp, Homo sapiens
  Payload ID: 13639
  Gene Symbol: PPP1R1B
  Gene Name: protein phosphatase 1, regulatory (inhibitor) subunit 1B
  Uniprot ID: Q9UD71
  ENST ID: ENST00000254079
  CDS Start-End: 470-1084
aaagctgggaccggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataact

SEQ ID NO: 170972 - DNA, 1419 bp, Homo sapiens
  Payload ID: 13639
  Gene Symbol: PPP1R1B
  Gene Name: protein phosphatase 1, regulatory (inhibitor) subunit 1B
  Uniprot ID: Q9UD71
  ENST ID: ENST00000394265
  CDS Start-End: 153-659
ttttcatttctcacaaggactgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataac

SEQ ID NO: 170973 - DNA, 1504 bp, Homo sapiens
  Payload ID: 13639
  Gene Symbol: PPP1R1B
  Gene Name: protein phosphatase 1, regulatory (inhibitor) subunit 1B
  Uniprot ID: Q9UD71
  ENST ID: ENST00000394267
  CDS Start-End: 237-743
ttttcatttctcacaaggactgggtgaagagttctgcagccttacagagactggaaaagaagcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaataact

SEQ ID NO: 170974 - DNA, 1038 bp, Homo sapiens
  Payload ID: 13639
  Gene Symbol: PPP1R1B
  Gene Name: protein phosphatase 1, regulatory (inhibitor) subunit 1B
  Uniprot ID: Q9UD71
  ENST ID: ENST00000580825
  CDS Start-End: 289-903
ttcaagttctggggagaccgcagggggccccccagctggctccccaggccttggctctaactcccaccctcctcccagccccaggagaacacgattctccatgctcattggccagtttcccctaaaccctccctccgagcacccgggcgccagtcccaggcggaggggacgggctggggaccccaaagctgggaccggaggcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaag

SEQ ID NO: 170975 - DNA, 875 bp, Homo sapiens
  Payload ID: 13639
  Gene Symbol: PPP1R1B
  Gene Name: protein phosphatase 1, regulatory (inhibitor) subunit 1B
  ENST ID: ENST00000582680
  CDS Start-End: 442-875
agaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccagatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtc

SEQ ID NO: 170976 - DNA, 1466 bp, Homo sapiens
  Payload ID: 13639
  Gene Symbol: PPP1R1B
  Gene Name: protein phosphatase 1, regulatory (inhibitor) subunit 1B
  ENST ID: ENST00000579000
  CDS Start-End: 194-709
gcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaat

SEQ ID NO: 170977 - DNA, 1636 bp, Homo sapiens
  Payload ID: 13640
  Gene Symbol: PPP1R1C
  Gene Name: protein phosphatase 1, regulatory (inhibitor) subunit 1C
  Uniprot ID: Q8WVI7
  ENST ID: ENST00000280295
  CDS Start-End: 235-585
agaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagctgggcttttgtcgttcacagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaa

SEQ ID NO: 170978 - DNA, 3004 bp, Homo sapiens
  Payload ID: 13640
  Gene Symbol: PPP1R1C
  Gene Name: protein phosphatase 1, regulatory (inhibitor) subunit 1C
  Uniprot ID: Q8WVI7
  ENST ID: ENST00000409137
  CDS Start-End: 244-573
attgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatctttaatttgtttccctttcttgatttctcataagttgcaaaataaaaataaaaataatttcacaaattgttcattattattatcctccctacttgccccaggatttaagtactaacttttacttcctactcttagactttgtattgccaaagaaataaaatatgaaaaagcataatcacccagacctacctgcggaattgtggattatgctgtagatattagatcattgaaaggaacaatatactacttaatgaggagccaaagacaacattctacctgctgctcccttcaagctgaggaatgagtttaattgacttcaaagtcccattattctcaaaagtagcaaaggtacaacatggctttgcatgaatcaaaggaagggaacaacaagaacttaaaaaaatagtttgcagatggttgaacatctctttaataattagagaagaatatcttttctttctttattgtttacagataccaacatttttcaaagccttgcagtagatgagtgagtctcctgttacatttctcctgcagcatatattctgtggatgtgttttcctaagcagactaattatatgttgctctcttcttttaccctaatgaaacatagatttttctgttttgaatttgtcacttgtttgttacatttgtcaagtgttttaaatattacattggtcctttatttgcttttgagaacacccaatagtttaaaaattaaaatgacatgaaggtcaattctaagacaggaatgatactactaaatcctggacttgcctatgataacaagctcgagctacacacttttattgtcagaataaatggaatatataggaaggagttaattggaactggttagtacctaaataagatttttcaaagtaagttttttgtcgtattggcagaacagtgttaaaaaatagacattgtcatcataaacacccacaactatatctgtagaagataatttaatgcaatattctggggaaaatacagttgccaaaattaatctccttgttttctttcattgtgcaatgtggagttaaattttttttctattgagcagtgtgtgtgtgtgtttgtgtctataatttatatatgtgcttgtatacatttctatatacacatgtatgtgtatgcaaaatatgtatatatacacatatatataaaatgtacactaaatatgtatatatgtatattcataaaatgttttgctgtatggaaataaaaaagaaggtttctaaaggaaagatagagaagaaa

SEQ ID NO: 170979 - DNA, 1157 bp, Homo sapiens
  Payload ID: 13640
  Gene Symbol: PPP1R1C
  Gene Name: protein phosphatase 1, regulatory (inhibitor) subunit 1C
  Uniprot ID: Q8WVI7
  ENST ID: ENST00000409702
  CDS Start-End: 90-419
ggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgcc

SEQ ID NO: 170980 - DNA, 839 bp, Homo sapiens
  Payload ID: 13641
  Gene Symbol: PPP1R2
  Gene Name: protein phosphatase 1, regulatory (inhibitor) subunit 2
  ENST ID: ENST00000438848
  CDS Start-End: 329-839
agatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgacc

SEQ ID NO: 170981 - DNA, 706 bp, Homo sapiens
  Payload ID: 13641
  Gene Symbol: PPP1R2
  Gene Name: protein phosphatase 1, regulatory (inhibitor) subunit 2
  ENST ID: ENST00000413183
  CDS Start-End: 134-376
gaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccataggtatatactttaaaaatcttaaaaaaaaaaaaagatacaagatctggctatgttgcccagtgcagtggctattaacaggcacagttatagcacactacagcctggaactcccgactcaagtgatcctccctcctccgcctcccagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaa

SEQ ID NO: 170982 - DNA, 872 bp, Homo sapiens
  Payload ID: 13641
  Gene Symbol: PPP1R2
  Gene Name: protein phosphatase 1, regulatory (inhibitor) subunit 2
  ENST ID: ENST00000418939
  CDS Start-End: 1-165
acgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataag

SEQ ID NO: 170983 - DNA, 3450 bp, Homo sapiens
  Payload ID: 13641
  Gene Symbol: PPP1R2
  Gene Name: protein phosphatase 1, regulatory (inhibitor) subunit 2
  Uniprot ID: P41236
  ENST ID: ENST00000618156
  CDS Start-End: 362-979
gttctcgccccgccctctccccgcctcctccctagatatcgcgagagggcgggtccgcttggcttcggcgtcgcgtcgctcctgcgctggagctctaggccggcgtctctccgcgagccgcgggtcaagtgccagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactctttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaa

SEQ ID NO: 170984 - DNA, 245 bp, Homo sapiens
  Payload ID: 13641
  Gene Symbol: PPP1R2
  Gene Name: protein phosphatase 1, regulatory (inhibitor) subunit 2
  ENST ID: ENST00000625807
  CDS Start-End: 3-245
caatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccataggtatatactttaa

SEQ ID NO: 170985 - DNA, 4525 bp, Homo sapiens
  Payload ID: 13642
  Gene Symbol: PPP1R10
  Gene Name: protein phosphatase 1, regulatory subunit 10
  Uniprot ID: Q96QC0
  ENST ID: ENST00000376511
  CDS Start-End: 554-3376
cattctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaagcagcttatttaa

SEQ ID NO: 170986 - DNA, 4525 bp, Homo sapiens; identical to SEQ ID NO: 170985
  Payload ID: 13642
  Gene Symbol: PPP1R10
  Gene Name: protein phosphatase 1, regulatory subunit 10
  Uniprot ID: Q96QC0
  ENST ID: ENST00000383586
  CDS Start-End: 554-3376

SEQ ID NO: 170987 - DNA, 4525 bp, Homo sapiens; identical to SEQ ID NO: 170985
  Payload ID: 13642
  Gene Symbol: PPP1R10
  Gene Name: protein phosphatase 1, regulatory subunit 10
  Uniprot ID: Q96QC0
  ENST ID: ENST00000426299
  CDS Start-End: 554-3376

SEQ ID NO: 170988 - DNA, 4525 bp, Homo sapiens; identical to SEQ ID NO: 170985
  Payload ID: 13642
  Gene Symbol: PPP1R10
  Gene Name: protein phosphatase 1, regulatory subunit 10
  Uniprot ID: Q96QC0
  ENST ID: ENST00000424446
  CDS Start-End: 554-3376

SEQ ID NO: 170989 - DNA, 4525 bp, Homo sapiens; identical to SEQ ID NO: 170985
  Payload ID: 13642
  Gene Symbol: PPP1R10
  Gene Name: protein phosphatase 1, regulatory subunit 10
  Uniprot ID: Q96QC0
  ENST ID: ENST00000429597
  CDS Start-End: 554-3376

SEQ ID NO: 170990 - DNA, 4525 bp, Homo sapiens; identical to SEQ ID NO: 170985
  Payload ID: 13642
  Gene Symbol: PPP1R10
  Gene Name: protein phosphatase 1, regulatory subunit 10
  Uniprot ID: Q96QC0
  ENST ID: ENST00000420949
  CDS Start-End: 554-3376

SEQ ID NO: 170991 - DNA, 4525 bp, Homo sapiens; identical to SEQ ID NO: 170985
  Payload ID: 13642
  Gene Symbol: PPP1R10
  Gene Name: protein phosphatase 1, regulatory subunit 10
  Uniprot ID: Q96QC0
  ENST ID: ENST00000449113
  CDS Start-End: 554-3376

SEQ ID NO: 170992 - DNA, 5582 bp, Homo sapiens
  Payload ID: 13643
  Gene Symbol: PPP1R12A
  Gene Name: protein phosphatase 1, regulatory subunit 12A
  Uniprot ID: O14974
  ENST ID: ENST00000261207
  CDS Start-End: 124-3216
agatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaatctga

SEQ ID NO: 170993 - DNA, 5721 bp, Homo sapiens
  Payload ID: 13643
  Gene Symbol: PPP1R12A
  Gene Name: protein phosphatase 1, regulatory subunit 12A
  Uniprot ID: O14974
  ENST ID: ENST00000450142
  CDS Start-End: 268-3360
gaagttacgttagattggccgccggtgacgggtggccgtgctgggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgtaccccttcattttaaaaggtcattgtgttctactgcctattttagattactttggggttggggaagggtgttttggtaagcaggattttaagtcctctctctctcgattggttttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataactgatcagtttgagtgactgcaacatgttctggttgcacaacagttaggcatgctatggtttatatttgtgaagtttggatgcctgtgaagaatgattaaatacatgtttctaatattttagtgttttgtatttaggttatttattctttgtatctaaaactgaacagctactgtgctatattgattttattggtagtattgagcagaccttgtttctgcatgaaactagttgcaaaacccactattttggaaataaaaatgtattttgacatatacaaataaaatgaataaaactattttaaatgtgtgaacttttaatgaagacattttaaattttgttctgagatatttaaattctgcatgggtattttttcactaattgctttacttggataccaatttgaataatttctgaaattgtaatattgtgataatttgcacagcattgtacatgcacatctgtaaatgcaatcttaattgccatatttatgcaatctgtgtaccaatttggacaaatgtttatatattttacataaagctgtctgtatgcagaa

SEQ ID NO: 170994 - DNA, 4639 bp, Homo sapiens
  Payload ID: 13643
  Gene Symbol: PPP1R12A
  Gene Name: protein phosphatase 1, regulatory subunit 12A
  Uniprot ID: O14974
  ENST ID: ENST00000437004
  CDS Start-End: 129-3116
gaggcagatctgccctgtagagccttgcggttccactgctggcctccggattcccgggagcccccagcccgacaggacaaccttccttccccgcttcctcctttccagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacagctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcacttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttttaaggaaaaaaaagcgcaaaaccaagtacatagtgacgatggcttttatttggacaaatagcttttatattttcattaaaccatgcaaaaaatactacatctttctggcacataactgtctccttaaccactgaacagttcagccatttgaataaattgtacattgtaaagcttatagtagctgattgtattattgattgtattgtatactatattaaatgtgaatttgt

SEQ ID NO: 170995 - DNA, 2275 bp, Homo sapiens
  Payload ID: 13643
  Gene Symbol: PPP1R12A
  Gene Name: protein phosphatase 1, regulatory subunit 12A
  ENST ID: ENST00000547330
  CDS Start-End: 200-2275
aagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcctcccccttccccccctcgcgataagaagacccggcggcaggagaggggatgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaa

SEQ ID NO: 170996 - DNA, 2925 bp, Homo sapiens
  Payload ID: 13643
  Gene Symbol: PPP1R12A
  Gene Name: protein phosphatase 1, regulatory subunit 12A
  Uniprot ID: O14974
  ENST ID: ENST00000550107
  CDS Start-End: 1-2925
atgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataa

SEQ ID NO: 170997 - DNA, 1101 bp, Homo sapiens
  Payload ID: 13643
  Gene Symbol: PPP1R12A
  Gene Name: protein phosphatase 1, regulatory subunit 12A
  ENST ID: ENST00000553081
  CDS Start-End: 1-1101
cacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaa

SEQ ID NO: 170998 - DNA, 631 bp, Homo sapiens
  Payload ID: 13643
  Gene Symbol: PPP1R12A
  Gene Name: protein phosphatase 1, regulatory subunit 12A
  ENST ID: ENST00000550510
  CDS Start-End: 1-631
ggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgctccatagtgaaaaacgggacaagaaatctccactaattgaatcaacagcaaata

SEQ ID NO: 170999 - DNA, 2977 bp, Homo sapiens
  Payload ID: 13643
  Gene Symbol: PPP1R12A
  Gene Name: protein phosphatase 1, regulatory subunit 12A
  Uniprot ID: O14974
  ENST ID: ENST00000546369
  CDS Start-End: 140-2971
atcatatgcttgtaagagaatgagagtattaaccttgtagacttctgtaaggggctaagagaaacactgagctaaataattgaggggatatactatgttcatggcttgaaagactgcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaa

SEQ ID NO: 171000 - DNA, 959 bp, Homo sapiens
  Payload ID: 13643
  Gene Symbol: PPP1R12A
  Gene Name: protein phosphatase 1, regulatory subunit 12A
  ENST ID: ENST00000550903
  CDS Start-End: 1-486
gagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagccctgtaagaccagtaataaatttctgtctactgatgattctattgaattgaaatgcagagccaatggcatctttcagaaaagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcag

SEQ ID NO: 171001 - DNA, 683 bp, Homo sapiens
  Payload ID: 13643
  Gene Symbol: PPP1R12A
  Gene Name: protein phosphatase 1, regulatory subunit 12A
  ENST ID: ENST00000550299
  CDS Start-End: 1-566
atgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggtgaccggcaagagtcagtatcttctgggcggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaa

SEQ ID NO: 171002 - DNA, 582 bp, Homo sapiens
  Payload ID: 13643
  Gene Symbol: PPP1R12A
  Gene Name: protein phosphatase 1, regulatory subunit 12A
  ENST ID: ENST00000548318
  CDS Start-End: 292-582
cctgataatgaaggctggataccactacatgcagcagcttcctgtggatatcttgatattgcagagtgtcaacaggcagaggtgggaactgaacccgaagtctgcagagcataaaagtttctgcttttttcacccctccaacctttgaattgcttttggagactatttatggtagataagaattaatccaccataggattaatcagtccgtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagca

SEQ ID NO: 171003 - DNA, 1257 bp, Homo sapiens
  Payload ID: 13643
  Gene Symbol: PPP1R12A
  Gene Name: protein phosphatase 1, regulatory subunit 12A
  ENST ID: ENST00000546762
  CDS Start-End: 1-703
agaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagctctccagtacaggatacaacagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgttttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttc

SEQ ID NO: 171004 - DNA, 897 bp, Homo sapiens
  Payload ID: 13643
  Gene Symbol: PPP1R12A
  Gene Name: protein phosphatase 1, regulatory subunit 12A
  ENST ID: ENST00000547131
  CDS Start-End: 1-897
gcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaacc

SEQ ID NO: 171005 - DNA, 560 bp, Homo sapiens
  Payload ID: 13643
  Gene Symbol: PPP1R12A
  Gene Name: protein phosphatase 1, regulatory subunit 12A
  ENST ID: ENST00000634739
  CDS Start-End: 1-303
cgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggtgaccggcaagagaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcat

SEQ ID NO: 171006 - DNA, 1687 bp, Homo sapiens
  Payload ID: 13644
  Gene Symbol: PPP1R12B
  Gene Name: protein phosphatase 1, regulatory subunit 12B
  Uniprot ID: O60237
  ENST ID: ENST00000356764
  CDS Start-End: 125-1285
cggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggtgcagtttgggagggtatgggggaattccaaggcagttttttttttccatgaaaattcaatcttaggaacaaatgaaaatattttctagtccttaagttgattttggaaatgcaaagtctttaaagagagagaggcacactgatagtttattcaagtagctatttgcttgctattgtttgcttgaccaaaaaagaaaataaaaaagctttaaaaata

SEQ ID NO: 171007 - DNA, 15431 bp, Homo sapiens
  Payload ID: 13644
  Gene Symbol: PPP1R12B
  Gene Name: protein phosphatase 1, regulatory subunit 12B
  ENST ID: ENST00000391959
  CDS Start-End: 154-3285
ggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaagtgcttcatttggtagaagtagtgaccccacaagtccctacatttcagccaatcgcaattcatctcctgctacctcacccattaccattggttcatctacctctcggggcagccagtggcaacctgcctcttcttgccctgcaccaatcagtgcaaacactactgcatctgtacatcatggcaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttgtgactgtctccacagttcagagcatgggatttctagaatctcacatctggggcagcctcttctgattttacatcttatcattggtgggggcctcgcccaccagcctcctacaactcctgtccacatagaggccccttccccagggacagccacagtgagtcatggccactgagaagggtctctggtagtatcaaggaatttcctaaatggagtcaggccaaggagaagcctagattggcgttcaaaagaaccgtaagatagatagatagatagatagatagatagatagatagatagatagatatcaaggttccaagcttcaagtaaccaagagtatatacggttatttcttggaagacaccaggtttaagtgacaaaggtgttgaggccatccaggtgaacactagcacactctagtacatgggaaagttgaggtctagggaggtggtgatttccttgggctcatggaagtctcctgccatcacccttagtcatctgctatatccataagtcttcatgaggtcattgtttaattcaggagatccaaaactatcctgtagttccaaactacaaatgtagttaacttgggggctattgaaggttaaatctaaactcaaaatgaaggagccatgcccagagaagagctgttcaggcccgctggcagggtttgtacgtgggtggccaggtctgaccccaggcagccaggatctgggtctggtttctccatccagcaagccctgcctctggctttgctcagccctgtgtttcctgccaagcggaaatccctggtcactgacttggggagaggtcagggagggaagattcttctcccctgatgtcacccagctgtttgtaacccaagcagcagcagaacaagcacacttgatgtcatggttgaagaattcagtcctgtcctggggcacaaaacagaggcaaagaagcatgaccgatgcaaagggttcctagactgcaaatgtcatttctctttctgacccccactggttgtagtaaggtctgcagatacagtatcacctagccgtcacgtggtccagccctcttggggggaaaggagaaggccacaacctattggcagagtaaaaagctcatattcttagccaggagaccctcaggtgataaatcccagtccgtctgctgaaaggctcatgcccctcaccctacccagccttagggactgaagcagcaagacaggatagatgttaaaggatctgggctcatgctccctcaggtgggcagctcccatccctgcttgcattcactgcccccatgcctttggacctgatggacaagcacacatctagccaacggtgttcctggaggacaggtgctggtgtaaactgacaaaaatggtagctgctggtctatcctcaaggagaggagacaggtggaagtgggaaccgaagaaggagttttactcttccctggtctttgggggcaatgctgtcccactctccctttccctaaaaattctgacgccctatccctggtccctaacatctttgcttcagaagttaaagacatttcaagttatttgcaaagagtcaactgaggactttgtagaaattgttacttttcaaattcccacttcccagggccagcctccctctcgtcattgggctcagactgtggctgttccctaagcccagctctactggaagggaattcaagaatatagtccccaccaccaccccgccccgcccagcctcccagacaatgttccccggcaccaccacactccccacagttccacagcctggcatgtgttctcaggagatgtgtgggccccagcacccaccagagtgccaatctggtcttcccccaaccccaggagagaggggacctcagccccttttggtgcttccctgaagggagattctgggttagaagccagagcctcaggaccatctcaccaccctcacccaccatactgaccctcacaggcagctcccactccctcacccccacctcagcgcagcaaaaacaaccagagacaccccccacccccaggtttctttcagctcatttctttaataaggagacgcagttcattacaaaataacaatttgacaagagatcagacaagaacaagagtccacataagggagatggagagcattgccaagcagaagtgggaatgagagggccgggggcaagggctgtacatgtgtccttcctatggagacgaaggcagggctcctggtgggctgaccttggcgaagctaggctctgccaggccctgattttgaagttttcagccccagggttttcagaaagcagcaaatcaagtccttagatgggcaggagtcagggcagaagggtcactatctttgaagaggcccccctaaagtcctgatcgctaaggcaggtgggatggaggaactcctggtgccccatgcacactgctcccatcacctcaccagacagatgctctctcaactcttgcctcaatttgtctctgctgtgggtgtggagagtgggagggccccagagagagctggaggaagcaagacatgtcttcactggtccaagcacctgattccagcctgctctgaaatggtcccctccaccttccccactctttcagttcccagcacaaaggtccctgggacttctgtgtgcaacttctgttgtggtttgtgcagggcaagcctgcctcgccacctctggcctcctcgaatgcgccctgcctgattcccttcccgttctctctccttcctcatacttgtcacagttgccaggcctgaggcatcctgggctcttcccatgcagtactgccctcaggtgcccatggggccaggggccgcaggcaggggggctacctgtccctctcagttcaacaggatgacctggggccttggaagcccccaggcccctctactcacctctgctacttggtgcaactggctggggcttctctggggagcaggtgtgaaggtcaggggacttagtccacacctgctctgcctgagcctctctcacagctgaacctgcccaccccactctcaggggatcgctggtagccctgaggttgccccgctattgggctgctttctgtcagactgcaggaggatgcacgagggaagagcgtcagcccctgtattcaccggcctctccctgagtccctcctccatcaccacccacagaccctcacactacagaggtgagtaagcagggatggttctgtcatccctggctgagctgctgactggctgctcctgaaaatcctggttgcctccacagggaccccaggaaaggtatccagaaccatggagtcccactgctgtctgctcctcgcccagcgtagagatggagctgaactgtgaacccaggccgagaaagccagctcgggcagggccagcatgggcatctcctgagaccccaccggaagccctggacaccgtccattctcatgacacgggactgagggagcaggagggagtgacaacaggtgagcccttcagaagtggtctgtggggagccagttggagagacatgggggctcctgggaggagccaagggaggccaaatctccagcaggaggccccctttatggcttttcagtgaattcaaacagtgggaggaaggggcacaccacacacatacacagaacatggaagctactgggatgccagataccaggctggacactgcaccgggccctgaggtttggctctgcaggcagatgtgcagcaaacaggccttcagggcgacagggtcctccagcatctcccaaggcagggctggactggagcaggcaccgactcccgcccactgatgactcccatggggggtttcccgatgggaggaggcaggggtggggctggggaacaaagactttacacgacataaaatcaaaggagcagcctcaaccagttctgtaaaatgggtttgaggttggggatcaaggggactctcagcattgccatgcggctatttacagaaagttatagacatgcatcttgattaaacaagattctgttcatatgtttctaggtaattatcttcttttatatataattaaatatacacggatgggggcagatgaggctcaaatggcttcagaaggttcttattttgttgttgcttaaaaaataaagtaattcatgtgtcttcaagtca

SEQ ID NO: 171008 - DNA, 1808 bp, Homo sapiens
  Payload ID: 13644
  Gene Symbol: PPP1R12B
  Gene Name: protein phosphatase 1, regulatory subunit 12B
  Uniprot ID: O60237
  ENST ID: ENST00000480184
  CDS Start-End: 133-1680
aaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggtgcagtttgggagggtatgggggaattccaaggcagttttttttttccatgaaaattcaatcttaggaacaaatgaaaatattttctagtccttaagttgattttggaaatgcaaagtctttaaagagagagaggcacactgatagtttattcaagtagctatttgcttgctattgtttgcttgaccaaaaaagaaaataaaaaagctttaaaaata

SEQ ID NO: 171009 - DNA, 1681 bp, Homo sapiens
  Payload ID: 13644
  Gene Symbol: PPP1R12B
  Gene Name: protein phosphatase 1, regulatory subunit 12B
  ENST ID: ENST00000476364
  CDS Start-End: 125-553
cggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggtgcagtttgggagggtatgggggaattccaaggcagttttttttttccatgaaaattcaatcttaggaacaaatgaaaatattttctagtccttaagttgattttggaaatgcaaagtctttaaagagagagaggcacactgatagtttattcaagtagctatttgcttgctattgtttgcttgaccaaaaaagaaaataaaaaagctttaaaaata

SEQ ID NO: 171010 - DNA, 635 bp, Homo sapiens
  Payload ID: 13644
  Gene Symbol: PPP1R12B
  Gene Name: protein phosphatase 1, regulatory subunit 12B
  ENST ID: ENST00000466968
  CDS Start-End: 1-635
gaacagagccaatgtaaaccagcaagacaacgagggctggacaccccttcatgcagcagcttcctgtggctatctcaacatagcagaacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgcta

SEQ ID NO: 171011 - DNA, 15248 bp, Homo sapiens
  Payload ID: 13644
  Gene Symbol: PPP1R12B
  Gene Name: protein phosphatase 1, regulatory subunit 12B
  Uniprot ID: O60237
  ENST ID: ENST00000608999
  CDS Start-End: 154-3102
ggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttgtgactgtctccacagttcagagcatgggatttctagaatctcacatctggggcagcctcttctgattttacatcttatcattggtgggggcctcgcccaccagcctcctacaactcctgtccacatagaggccccttccccagggacagccacagtgagtcatggccactgagaagggtctctggtagtatcaaggaatttcctaaatggagtcaggccaaggagaagcctagattggcgttcaaaagaaccgtaagatagatagatagatagatagatagatagatagatagatagatagatatcaaggttccaagcttcaagtaaccaagagtatatacggttatttcttggaagacaccaggtttaagtgacaaaggtgttgaggccatccaggtgaacactagcacactctagtacatgggaaagttgaggtctagggaggtggtgatttccttgggctcatggaagtctcctgccatcacccttagtcatctgctatatccataagtcttcatgaggtcattgtttaattcaggagatccaaaactatcctgtagttccaaactacaaatgtagttaacttgggggctattgaaggttaaatctaaactcaaaatgaaggagccatgcccagagaagagctgttcaggcccgctggcagggtttgtacgtgggtggccaggtctgaccccaggcagccaggatctgggtctggtttctccatccagcaagccctgcctctggctttgctcagccctgtgtttcctgccaagcggaaatccctggtcactgacttggggagaggtcagggagggaagattcttctcccctgatgtcacccagctgtttgtaacccaagcagcagcagaacaagcacacttgatgtcatggttgaagaattcagtcctgtcctggggcacaaaacagaggcaaagaagcatgaccgatgcaaagggttcctagactgcaaatgtcatttctctttctgacccccactggttgtagtaaggtctgcagatacagtatcacctagccgtcacgtggtccagccctcttggggggaaaggagaaggccacaacctattggcagagtaaaaagctcatattcttagccaggagaccctcaggtgataaatcccagtccgtctgctgaaaggctcatgcccctcaccctacccagccttagggactgaagcagcaagacaggatagatgttaaaggatctgggctcatgctccctcaggtgggcagctcccatccctgcttgcattcactgcccccatgcctttggacctgatggacaagcacacatctagccaacggtgttcctggaggacaggtgctggtgtaaactgacaaaaatggtagctgctggtctatcctcaaggagaggagacaggtggaagtgggaaccgaagaaggagttttactcttccctggtctttgggggcaatgctgtcccactctccctttccctaaaaattctgacgccctatccctggtccctaacatctttgcttcagaagttaaagacatttcaagttatttgcaaagagtcaactgaggactttgtagaaattgttacttttcaaattcccacttcccagggccagcctccctctcgtcattgggctcagactgtggctgttccctaagcccagctctactggaagggaattcaagaatatagtccccaccaccaccccgccccgcccagcctcccagacaatgttccccggcaccaccacactccccacagttccacagcctggcatgtgttctcaggagatgtgtgggccccagcacccaccagagtgccaatctggtcttcccccaaccccaggagagaggggacctcagccccttttggtgcttccctgaagggagattctgggttagaagccagagcctcaggaccatctcaccaccctcacccaccatactgaccctcacaggcagctcccactccctcacccccacctcagcgcagcaaaaacaaccagagacaccccccacccccaggtttctttcagctcatttctttaataaggagacgcagttcattacaaaataacaatttgacaagagatcagacaagaacaagagtccacataagggagatggagagcattgccaagcagaagtgggaatgagagggccgggggcaagggctgtacatgtgtccttcctatggagacgaaggcagggctcctggtgggctgaccttggcgaagctaggctctgccaggccctgattttgaagttttcagccccagggttttcagaaagcagcaaatcaagtccttagatgggcaggagtcagggcagaagggtcactatctttgaagaggcccccctaaagtcctgatcgctaaggcaggtgggatggaggaactcctggtgccccatgcacactgctcccatcacctcaccagacagatgctctctcaactcttgcctcaatttgtctctgctgtgggtgtggagagtgggagggccccagagagagctggaggaagcaagacatgtcttcactggtccaagcacctgattccagcctgctctgaaatggtcccctccaccttccccactctttcagttcccagcacaaaggtccctgggacttctgtgtgcaacttctgttgtggtttgtgcagggcaagcctgcctcgccacctctggcctcctcgaatgcgccctgcctgattcccttcccgttctctctccttcctcatacttgtcacagttgccaggcctgaggcatcctgggctcttcccatgcagtactgccctcaggtgcccatggggccaggggccgcaggcaggggggctacctgtccctctcagttcaacaggatgacctggggccttggaagcccccaggcccctctactcacctctgctacttggtgcaactggctggggcttctctggggagcaggtgtgaaggtcaggggacttagtccacacctgctctgcctgagcctctctcacagctgaacctgcccaccccactctcaggggatcgctggtagccctgaggttgccccgctattgggctgctttctgtcagactgcaggaggatgcacgagggaagagcgtcagcccctgtattcaccggcctctccctgagtccctcctccatcaccacccacagaccctcacactacagaggtgagtaagcagggatggttctgtcatccctggctgagctgctgactggctgctcctgaaaatcctggttgcctccacagggaccccaggaaaggtatccagaaccatggagtcccactgctgtctgctcctcgcccagcgtagagatggagctgaactgtgaacccaggccgagaaagccagctcgggcagggccagcatgggcatctcctgagaccccaccggaagccctggacaccgtccattctcatgacacgggactgagggagcaggagggagtgacaacaggtgagcccttcagaagtggtctgtggggagccagttggagagacatgggggctcctgggaggagccaagggaggccaaatctccagcaggaggccccctttatggcttttcagtgaattcaaacagtgggaggaaggggcacaccacacacatacacagaacatggaagctactgggatgccagataccaggctggacactgcaccgggccctgaggtttggctctgcaggcagatgtgcagcaaacaggccttcagggcgacagggtcctccagcatctcccaaggcagggctggactggagcaggcaccgactcccgcccactgatgactcccatggggggtttcccgatgggaggaggcaggggtggggctggggaacaaagactttacacgacataaaatcaaaggagcagcctcaaccagttctgtaaaatgggtttgaggttggggatcaaggggactctcagcattgccatgcggctatttacagaaagttatagacatgcatcttgattaaacaagattctgttcatatgtttctaggtaattatcttcttttatatataattaaatatacacggatgggggcagatgaggctcaaatggcttcagaaggttcttattttgttgttgcttaaaaaataaagtaattcatgtgtcttcaagtca

SEQ ID NO: 171012 - DNA, 2046 bp, Homo sapiens
  Payload ID: 13644
  Gene Symbol: PPP1R12B
  Gene Name: protein phosphatase 1, regulatory subunit 12B
  Uniprot ID: O60237
  ENST ID: ENST00000491336
  CDS Start-End: 828-1454
gttgctggtacaatctcataaaatgggctccagtgtttagagaaggacagtcagaggagtggccacctgtttgttgaaaattgggcttctgggaaagttgctgcacaagtgtgtggcaaggtgtgtctgagatagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggatgctaactccagtgtgctgagttgagacatcagcaagtgctgggcctggaatgtcagaagcagcaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacc

SEQ ID NO: 171013 - DNA, 2227 bp, Homo sapiens
  Payload ID: 13644
  Gene Symbol: PPP1R12B
  Gene Name: protein phosphatase 1, regulatory subunit 12B
  Uniprot ID: O60237
  ENST ID: ENST00000290419
  CDS Start-End: 828-1502
gttgctggtacaatctcataaaatgggctccagtgtttagagaaggacagtcagaggagtggccacctgtttgttgaaaattgggcttctgggaaagttgctgcacaagtgtgtggcaaggtgtgtctgagatagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggatgctaactccagtgtgctgagttgagacatcagcaagtgctgggcctggaatgtcagaagcagcaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacc

SEQ ID NO: 171014 - DNA, 878 bp, Homo sapiens
  Payload ID: 13644
  Gene Symbol: PPP1R12B
  Gene Name: protein phosphatase 1, regulatory subunit 12B
  ENST ID: ENST00000634903
  CDS Start-End: 301-861
tctaggcataaaaggtgttgctcagcacaataccctctacggtaagctaccagtcctgagaacctgtggtcaaagctgaattgaaaatattgatggaactcagactctgtgtaactggggactggttcagagctcaagactataatttacagggctgcttttatcctttatttagttctatccaaagtcatcttgcatcaactcaaaaggagagattctgtgagggtaacctacagggaaatttcccagctttgtgtgaagaatccagtggttgagtgtctatctgcatcctgaggaaccatgtcctctttatatacccgaagtaaagaattcactcggaataggaaatctcagtctgattctcccccagcatctccctccccgactgccaagacgctccgacatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagattta

SEQ ID NO: 171015 - DNA, 380 bp, Homo sapiens
  Payload ID: 13644
  Gene Symbol: PPP1R12B
  Gene Name: protein phosphatase 1, regulatory subunit 12B
  ENST ID: ENST00000434615
  CDS Start-End: 1-63
ccacagacaattgctccctccacctatgtatcaacttacttgaaaagatccatcaagatgtgaaactcgcaagtttggtgcagagaagtgcttcatttggtagaagtagtgaccccacaagtccctacatttcagccaatcgcaattcatctcctgctacctcacccattaccattggttcatctacctctcggggcagccagtggcaacctgcctcttcttgccctgcaccaatcagtgcaaacactactgcatctgtacatcatggcaggactcctcacaaatcccaggccgacacaacagcagagaaaacagcagacaatgtctcttctagcaccccgctctgtgtgatcaccaatcgccctcttcctagcactgcc

SEQ ID NO: 171016 - DNA, 350 bp, Homo sapiens
  Payload ID: 13644
  Gene Symbol: PPP1R12B
  Gene Name: protein phosphatase 1, regulatory subunit 12B
  ENST ID: ENST00000466273
  CDS Start-End: 1-25
gtggcaggttacatgttcgaattgacttgctagtagcatctcacctccttgagtgaaggaacgtcttcttgaaggacaacttaaaagcctactcagagtatcaagattcagtgggtagagcatcagcattcttctgctgtccttgacatagcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactga

SEQ ID NO: 171017 - DNA, 2924 bp, Homo sapiens
  Payload ID: 13645
  Gene Symbol: PPP1R12C
  Gene Name: protein phosphatase 1, regulatory subunit 12C
  Uniprot ID: Q9BZL4
  ENST ID: ENST00000263433
  CDS Start-End: 17-2365
gcgggcgggcggtgcgatgtccggagaggatggcccggcggctggcccgggggcggcggcggcggctgcccgggagcggcgacgggagcagctgcggcagtggggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 171018 - DNA, 2363 bp, Homo sapiens
  Payload ID: 13645
  Gene Symbol: PPP1R12C
  Gene Name: protein phosphatase 1, regulatory subunit 12C
  Uniprot ID: Q9BZL4
  ENST ID: ENST00000435544
  CDS Start-End: 129-2252
actccttcctcagctccagttcaggtcccggagcccacccagtgtccacaaggcctggggcaagtccctcctccgaccccctggacttcggcttttgtccccccaagttttggacccctaagggaagaatgagaaacggtggcccgtgtcagcccctggctgcagggccccgtgcagagggggcctcagtgaactggagtgtgacagcctggggcccaggcacacaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagcca

SEQ ID NO: 171019 - DNA, 2269 bp, Homo sapiens
  Payload ID: 13645
  Gene Symbol: PPP1R12C
  Gene Name: protein phosphatase 1, regulatory subunit 12C
  ENST ID: ENST00000592993
  CDS Start-End: 1-2213
cccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggccccccatccaggacgaggatgagggggaagaaggtcccaccgaaccaccccctgcagaacccagaaccctcaatggcgtctcctccccgccgcaccccagccctaagagtcccgtgcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggccaaggagctccgtcttgccagaattaccccgaccccctccccgaagctgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagaggcgcccgacgggcagggtccgggaccgcaggcggccagggagcaccgcaaggtcggaaaggagtggagggggcctgcggagggggaggaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccc

SEQ ID NO: 171020 - DNA, 1262 bp, Homo sapiens
  Payload ID: 13645
  Gene Symbol: PPP1R12C
  Gene Name: protein phosphatase 1, regulatory subunit 12C
  ENST ID: ENST00000591938
  CDS Start-End: 1-704
ctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggcggagccggctgaccgcagccaggagtccagcaccctggagggcggcccctcggcccgcaggcagcggtggcagcgggacctcaacccagaacctgagccagaatcggaagagccagacggaggctttaggacgctgtatgcagagctgcgcagggagaacgagcggcttcgcgaggccctgaccgagaccacgctgcggctggcgcagctcaaggtggagctggagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactca

SEQ ID NO: 171021 - DNA, 3104 bp, Homo sapiens
  Payload ID: 13646
  Gene Symbol: PPP1R13L
  Gene Name: protein phosphatase 1, regulatory subunit 13 like
  Uniprot ID: Q8WUF5
  ENST ID: ENST00000360957
  CDS Start-End: 62-2548
gctggaggaagcccccaggtgccaggatctgcccggatccgcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggcccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaattga

SEQ ID NO: 171022 - DNA, 3118 bp, Homo sapiens
  Payload ID: 13646
  Gene Symbol: PPP1R13L
  Gene Name: protein phosphatase 1, regulatory subunit 13 like
  Uniprot ID: Q8WUF5
  ENST ID: ENST00000418234
  CDS Start-End: 80-2566
cttcctaagccttaaagagacaggacggtcgattggtctgaaattcttgaagagacaggcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggcccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 171023 - DNA, 355 bp, Homo sapiens
  Payload ID: 13646
  Gene Symbol: PPP1R13L
  Gene Name: protein phosphatase 1, regulatory subunit 13 like
  ENST ID: ENST00000589371
  CDS Start-End: 1-273
gagaccgactggtggtgggccgcgctgcacggccaggagggctacgtgccgcggaactacttcgggatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 171024 - DNA, 525 bp, Homo sapiens
  Payload ID: 13646
  Gene Symbol: PPP1R13L
  Gene Name: protein phosphatase 1, regulatory subunit 13 like
  ENST ID: ENST00000593226
  CDS Start-End: 141-525
ggacggtcgattggtctgaaattcttgaagagacagctcctgccccgccccgttctccgctccccaagccggagcccgagctggaggaagcccccaggtgccaggatctgcccggatccgcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagc

SEQ ID NO: 171025 - DNA, 648 bp, Homo sapiens
  Payload ID: 13646
  Gene Symbol: PPP1R13L
  Gene Name: protein phosphatase 1, regulatory subunit 13 like
  ENST ID: ENST00000591986
  CDS Start-End: 1-89
tcgagaagtgcgacccttaccgcgagggttatgctgactgcgccacctacctggcagctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 171026 - DNA, 392 bp, Homo sapiens
  Payload ID: 13646
  Gene Symbol: PPP1R13L
  Gene Name: protein phosphatase 1, regulatory subunit 13 like
  ENST ID: ENST00000592134
  CDS Start-End: 213-392
ctccgctccccaagccggagcccgagctggaggaagcccccaggtgccaggatctgcccggatcctctcttcttcctgaggcctcaattctcagagctctgaattcttcctgcaccttctgaccaggtggattcttacagtagtcctatgaggtgaactttcatccccattttacggattacgagactgaggcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcag

SEQ ID NO: 171027 - DNA, 2504 bp, Homo sapiens
  Payload ID: 13646
  Gene Symbol: PPP1R13L
  Gene Name: protein phosphatase 1, regulatory subunit 13 like
  ENST ID: ENST00000612351
  CDS Start-End: 906-1952
ggctggagtgcagtggtgcagtggtgcaatctcggctcactgcaacctccgcctcctgggttcaagcgattcctgtgcctcagccttccgagtagctgggattacaggcatgtgccaccacgcccagctaatttttttttttttttttttttttttgtatttttagtagagacagggttttaccatgttggccaggctggtctcaaactcctgatctcaagagatctgcctgcctcggcctcccaaagttctgggattacaggtgtgagccactcgactcagccaataatgcatatttttatttccacctgctttactgtcagaatgagtaagacagagaagaaatcattaaacaccaggattctacttcctgctggagttttctgcctgagatgttaggagaggaaactctcaggatctcagaaaatcacatctatcacggttggtagaagtagattctagagtcagccagaactgagttcaagtcccaactgcatggctttgggcaactgacttgtcctctctgaggcccagattccctttcggtaatgtggagatggcagtgtatctacctcacaaagcagtggtgagattacaataaggtaggcatgtaaagcgccaggcacatactaactgctcaataaatgggaggcatcataattgtatattattcacagcccaaggaaagtgtagcccagagagggcaaggaacttccctgaggtcacacagaaaatcatgtgctggttgtatgccctggaagttgtggagagggagtgttgggtgtctcctggggacctgtcctctgatgggctcttgttccggctaggaccccccaaaccccccaccgagctggagcctgagccggagatagaggggctgctgacaccagtgctggaggctggcgatggaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggcggagccagagctgtcccccatcactgagggatctgaggccagggcagggccccctgctcctgccccaccagctcccattccaccccgccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaa

SEQ ID NO: 171028 - DNA, 4958 bp, Homo sapiens
  Payload ID: 13647
  Gene Symbol: PPP1R13B
  Gene Name: protein phosphatase 1, regulatory subunit 13B
  Uniprot ID: Q96KQ4
  ENST ID: ENST00000202556
  CDS Start-End: 284-3556
gggcgggcgggccgcaggctgtcgggctggggctgaggctgaggctgaggttgaggcggcggcggcggcggccgggtgcccgggacagcgacgcagcgcgccggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 171029 - DNA, 611 bp, Homo sapiens
  Payload ID: 13647
  Gene Symbol: PPP1R13B
  Gene Name: protein phosphatase 1, regulatory subunit 13B
  ENST ID: ENST00000553739
  CDS Start-End: 181-611
gcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatggtttcagagaaccctcacataaaacttactgcacctggccgggcactgtggctcactcttgtaatctcaacactttgggaggccgagaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtac

SEQ ID NO: 171030 - DNA, 4254 bp, Homo sapiens
  Payload ID: 13647
  Gene Symbol: PPP1R13B
  Gene Name: protein phosphatase 1, regulatory subunit 13B
  ENST ID: ENST00000557082
  CDS Start-End: 106-474
actctgcaggcgcattcccgtagccttcgcggttgtactgaggaaaggtgccgagtgcacggatttggagagccatcttaggaattcccttttcccgtatctgcaatgttgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggactcatatctgggataacatactgttacaattcaacaagaagaagacaaccaacttaaaaatagacatctcatcaaagaagagagacaagtggctaacaggcatatgaaaagatgcttaacatttccagtcattggggaaacgcaaattgaaaccacagtgagacaccattacacatccacaagaattaagctataagcaaaaagacaaatattagcaagaatgtggacacactggtgtccattgctggtggaaatgtaaaatagtgcaatcgctttggagaacagtttggcagtcttttaaaaagctaaacataaactcaccatacaagccaggaattccactcctaggtatctactcaagagaaatgaaatatctgctcgcacagacttctatgcaaatgtgcacagcagcactgttactcataccagctaagaaatagcccaaatgtccattaactggtgaatggataaacaaattgtggtgtatccatctgactgaatatgatgcagcattaaaaagaaaccactcaacacagatgaacctcaaaaacctcacagcaggtgtgaaagactacctatggtatgacttcacttatatgaagcgtccggaagaaagttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaac

SEQ ID NO: 171031 - DNA, 671 bp, Homo sapiens
  Payload ID: 13647
  Gene Symbol: PPP1R13B
  Gene Name: protein phosphatase 1, regulatory subunit 13B
  ENST ID: ENST00000557587
  CDS Start-End: 1-320
gcaaacagctggtggagagtggtgccgccatttttgcctcaaccataagcgacattgaaactgctgcagacaagtgtgaggagatggaggaaggctacatccagtgctcccagtttctatatggaaagctgcagctagaaaatggtcttaatggtgctcactttagcagacagcgtccacaatgtgaatcctacagtttccaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 171032 - DNA, 3473 bp, Homo sapiens
  Payload ID: 13647
  Gene Symbol: PPP1R13B
  Gene Name: protein phosphatase 1, regulatory subunit 13B
  ENST ID: ENST00000556597
  CDS Start-End: 1-1906
tgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccg

SEQ ID NO: 171033 - DNA, 504 bp, Homo sapiens
  Payload ID: 13647
  Gene Symbol: PPP1R13B
  Gene Name: protein phosphatase 1, regulatory subunit 13B
  ENST ID: ENST00000555734
  CDS Start-End: 57-504
cggccgcggggagaagcagatgcatttggggccggtcatctcctcggtcctctcagatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaagg

SEQ ID NO: 171034 - DNA, 2378 bp, Homo sapiens
  Payload ID: 13648
  Gene Symbol: PPP1R15A
  Gene Name: protein phosphatase 1, regulatory subunit 15A
  Uniprot ID: O75807
  ENST ID: ENST00000200453
  CDS Start-End: 270-2294
ataaaagcctagtggccattgtgttcgttgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgt

SEQ ID NO: 171035 - DNA, 1725 bp, Homo sapiens
  Payload ID: 13648
  Gene Symbol: PPP1R15A
  Gene Name: protein phosphatase 1, regulatory subunit 15A
  ENST ID: ENST00000600406
  CDS Start-End: 1-776
gtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtaggtgctgagagcccagattctattttttttttttttttaattgagttggagtcttgggctgtcacccaggctggagtgcagcggcatgatcttggctcactgccaacctctgccgcccaagttcaggcgattctcgtgcctcagcctccagagtatctgggattacaggcgcatgacaccacacccagctaattttttttgtatttttagtagagacgggggttttgccatgttggccaggctggtctcaaactcctgacatcacgtgatccacccatctcagcctcccaaagtgctgggattacaggcgtgagctaccacatctggctgagagcccagattcttgagtcttagaaagaaagggggctgggggccgagacttctgggtccctgtatgttgcagagggttgcatgtcatctccatggagaaggctgtgtacgctgtcacgcaatcccttgtaagaggccaggcccctgggggaggagggagcagctgtggctcacagcagccccaggaaaccacctcttccttcagtgagtcagatagatagagaatcccgtgacagtgacaggcaagtgactagccagatagaaagcatttttgtgtaataactaatttttgtttgcttctctctctctcttccccgccctccccatccggattcccgtggctgtgtgcatctcctgcctgtgtccccatgtctgcccgcaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataa

SEQ ID NO: 171036 - DNA, 5227 bp, Homo sapiens
  Payload ID: 13649
  Gene Symbol: PPP1R15B
  Gene Name: protein phosphatase 1, regulatory subunit 15B
  Uniprot ID: Q5SWA1
  ENST ID: ENST00000367188
  CDS Start-End: 381-2522
agccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgccgcctattgcgcgggctgttcttccctgtgttctgccgcccgctgccgcattcgctgccctctgtggcttttctgctggctcgaagatcggcctggagcagcgacgccaccgctgggcaaggccgagactctgtaggcttcctccgaatcccgtcgacctccagccgctgagcgccgcggccctacctgagagactgtcaagaaaaaggagatggagccggggacaggcggatcgcggaaacggcttggccctcgggcgggcttccggttctggccaccctttttccctcggcgatcgcaagcaggctcttctaagttcccgacgcctcttggcccggaaaactccgggaaccccacactgctttcctctgcccagcccgagactcgggtcagttactggacgaaactgctctcccagctccttgcgccgctccccggattgcttcagaaggtgctaatttggagccaacttttcggtggaatgtttccgaccagatggctagattttgctggagtctacagcgccctgagagccctgaagggacgggagaaaccagccgcccccacagcgcagaaatctttgagttcgctgcagctcgactcctcagacccctcggtcaccagtccccttgattggctagaggaggggatccactggcaatactcgcccccagacctaaaattggagcttaaggccaagggaagtgctttggaccctgcagcacaggcttttctcttagagcagcagctgtggggagtggagctgttgcccagtagccttcaatcccgtctgtactctaaccgggaacttggctcttcgccctctgggcctctaaacattcaacgcatagacaatttcagtgtggtatcctatttgctgaacccttcctacctggactgctttcctaggctagaagtcagctatcagaacagtgatggaaatagcgaggtagtcggcttccagacactaaccccagagagcagctgcctgagagaggaccattgtcatccccagccgctgagtgcagaactcattccggcctcgtggcagggatgtccacctctttctacggaaggcctaccagaaattcaccatcttcgcatgaaacggctggaattccttcaacaggctagcaaggggcaagatttacccacccctgaccaggataatggctaccacagcctggaggaggaacacagccttctccggatggatccaaaacactgcagagataacccaacacagtttgttcctgctgctggagacattcctggaaacacccaggaatccactgaagaaaaaatagaattattaactacagaggttccacttgctttggaagaagagagcccttctgagggctgtccatctagtgagatacctatggaaaaggagcctggagagggccgaataagtgtagttgattactcatacctagaaggtgaccttcccatttctgccagaccagcttgtagtaacaaactgatagattatattttgggaggtgcatccagtgacctggaaacaagttctgatccagaaggtgaggattgggatgaggaagctgaggatgatggttttgatagtgatagctcactgtcagactcagaccttgaacaagaccctgaagggcttcacctttggaactctttctgcagtgtagatccttataatccccagaactttacagcaacaattcagactgctgccagaattgttcctgaagagccttctgattcagagaaggatttgtctggcaagtctgatctagagaattcctcccagtctggaagccttcctgagacccctgagcatagttctggggaggaagatgactgggaatctagtgcagatgaagcagagagtctcaaactgtggaactcattctgtaattctgatgacccctacaaccctttaaattttaaggctccttttcaaacatcaggggaaaatgagaaaggctgtcgtgactcaaagaccccatctgagtccattgtggccatttctgagtgtcacaccttactttcttgtaaggtgcagctgttggggagccaagaaagtgaatgtccagactcggtacagcgtgacgttctttctggaggaagacacacacatgtcaaaagaaaaaaggtaaccttccttgaagaagttactgagtattatataagtggtgatgaggatcgcaaaggaccatgggaagaatttgcaagggatggatgcaggttccagaaacgaattcaagaaacagaagatgctattggatattgcttgacatttgaacacagagaaagaatgtttaatagactccagggaacatgcttcaaaggacttaatgttctcaagcaatgttgagttggcagcctgtagtcctagctagcatacactacctcttacctgagaggtgtcttttaaaaacaaatcttggcagctgtcctttgacatttttttttttagaggaaatgtaacttggatctagtttaatttttttttttgcaacatatcccactcagaaacattcaggtttgaagccagccctgataatgaaggatgaactagtgtgatttctaatcctcccttttttgatttagttggatgtgcttttaaatgtcctttgcctgcatgaggtggaaaggggacctttttgagttgtcattttgcactttcaaaacttattttcttggaaaacaatatttatagggcttaaagcccattttcatttctaatctaaattatgtgtgcctatctgaaaactttgggctctttcttgtttctttcccaaaattcagaagttaatgggcttttatgtttttctatattttttttatttcaatgatttggcctgtctatgttaggctaaaaaataaccttgtgtatgctaccaacttaaagtgcattattttgtgtcacttttttttttcttgtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccactgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattaaa

SEQ ID NO: 171037 - DNA, 2722 bp, Homo sapiens
  Payload ID: 13650
  Gene Symbol: PPP1R16A
  Gene Name: protein phosphatase 1, regulatory subunit 16A
  Uniprot ID: Q96I34
  ENST ID: ENST00000292539
  CDS Start-End: 918-2504
ccaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 171038 - DNA, 2273 bp, Homo sapiens
  Payload ID: 13650
  Gene Symbol: PPP1R16A
  Gene Name: protein phosphatase 1, regulatory subunit 16A
  Uniprot ID: Q96I34
  ENST ID: ENST00000435887
  CDS Start-End: 470-2056
gtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgg

SEQ ID NO: 171039 - DNA, 657 bp, Homo sapiens
  Payload ID: 13650
  Gene Symbol: PPP1R16A
  Gene Name: protein phosphatase 1, regulatory subunit 16A
  ENST ID: ENST00000529009
  CDS Start-End: 462-657
cacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagc

SEQ ID NO: 171040 - DNA, 6251 bp, Homo sapiens
  Payload ID: 13651
  Gene Symbol: PPP1R16B
  Gene Name: protein phosphatase 1, regulatory subunit 16B
  Uniprot ID: Q96T49
  ENST ID: ENST00000299824
  CDS Start-End: 190-1893
ctctgtcgccgctggagcagctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 171041 - DNA, 6106 bp, Homo sapiens
  Payload ID: 13651
  Gene Symbol: PPP1R16B
  Gene Name: protein phosphatase 1, regulatory subunit 16B
  Uniprot ID: Q96T49
  ENST ID: ENST00000373331
  CDS Start-End: 171-1748
gctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 171042 - DNA, 2268 bp, Homo sapiens
  Payload ID: 13652
  Gene Symbol: PPP1R17
  Gene Name: protein phosphatase 1, regulatory subunit 17
  Uniprot ID: O96001
  ENST ID: ENST00000342032
  CDS Start-End: 629-1096
gtaagtagatatgtgtgaagtctctagaagagtgtctggcattttggtagccttacataaatgttagcagtagctacccttctcttcctcctcatgatagtactttgagaagcagcaatagtgattgaaagtactctggatttaaacttaaatagctttgagagtcgaaattagctgtggcctctcttgggcatatcacttaacttcttgtgcctcagtttccatatttacaaaatcaggccaaaaaaaatctatcgcatgggaattcaatgatgtagctggtttgtctgaatttctctggtgtgcacaccggaaactcaaagcacgactctatactgtacttttgtaatgtacaatgattgccgtggagagcagcgatggagatgttagtcctctttccttctccatcccccttgccctggtgcctgtgaaacagagcatccccatggcaacagcagcagctggtccctagataagaggagctggagccggccagcagcagccactgccgcagaggagccaggcccagcctcggtgagcacacacgccctccctgtctctcgccttcgcttccctgcatctgcgctgattgtgctggagaagaaatacatccacccaccctcctttgatgatgtccactgagcaaatgcagccactggaactctcagaagacagactggacaagctagaccctcgttgcagccacttagatgatctttcagaccagttcattaaggactgtgatctcaaaaagaagcctagaaagggaaaaaatgtacaggccaccctgaatgttgagtcagaccaaaaaaaaccaaggaggaaagatacaccggcgctgcacatcccacctttcataccaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggacgagagacccaaagcaatcgtggaagatgacgaaaaggatggtgacaagatagctatttaaagatagttcccctgagaccacttgtaaataggttagattggttccctgtggtgacctagagaaaaaatagacttgtttctgctctcatttttgtcatcgtctgacttgaagattcagacaccttctccccaggagatgtatgccatcaaattgccagtcacctctttgtctctctcttctttctgagtatggtttctattctgtgttttgaatttttattttctaatgcagtggaaaagaaacagatcatcctaaatgaggaggtaacagggaaagcactggggttcggtttctgcatcttctggatcaattcacggaacagagatcgtggattacatgggctccttcttggtttttgctgctgggcaggacttgacttagcattatccaagcaccagtccaagtggggttccctgttgccagttagagaggtgagaatgtttggactctaactcaccgattgctttgcagacaaaggtcttttatttctcctgtcctatcttaagagtccaaatgtctctggtgatgttcctaagacccttgtcccagatactctaaatgtgaatgtatgagctgggggagtcaacccagcccaccatgccttggctgatgataccagaggcagagagtgctggtctgtctgggaagcttagcaatgtatcttcaaatttatttttgtttttaaaaatatttcttaaacatgctgtcccaacatttgtgagttgtgtcacaagtgagtcattatcaatggtagataaaatatcaatgtttgtgatgaatttactgtaaaaaaattaaggtcaatgaaagccattctgttatttttagcattctcacttatttagactctattacactttcttggatgagaggggagagtgtggtgttagctagtgagcagaggtctgtatattgtccttgccccagcctgcaatctgtggatgcccaggggaaggcatacaggcctcatccaccaggcaatagacaggagagaggtgagaactatttttagaaggaggaaaagtagatacgcaaattgtcacaactaagagtgataatttggtagctctgtatgtatgctggttccaactgtttaatcccttctgtctttctgttctcacaaagatggaaaagatacaagagcttgccggaaataaagctacatctatcca

SEQ ID NO: 171043 - DNA, 569 bp, Homo sapiens
  Payload ID: 13652
  Gene Symbol: PPP1R17
  Gene Name: protein phosphatase 1, regulatory subunit 17
  Uniprot ID: O96001
  ENST ID: ENST00000409146
  CDS Start-End: 129-443
agccactgccgcagaggagccaggcccagcctcggtgagcacacacgccctccctgtctctcgccttcgcttccctgcatctgcgctgattgtgctggagaagaaatacatccacccaccctcctttgatgatgtccactgagcaaatgcagccactggaactctcagaagacagactggacaagctagaccctcgttgcagccacttaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggacgagagacccaaagcaatcgtggaagatgacgaaaaggatggtgacaagatagctatttaaagatagttcccctgagaccacttgtaaataggttagattggttccctgtggtgacctagagaaaaaatagacttgtttctgctctcatttttgtcatcgtctgacttgaagattcagacaccttct

SEQ ID NO: 171044 - DNA, 4599 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000274853
  CDS Start-End: 1878-3719
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtggctatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171045 - DNA, 2853 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000383573
  CDS Start-End: 132-1973
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtggactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171046 - DNA, 2853 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000399199
  CDS Start-End: 132-1973
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171047 - DNA, 4599 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000400554
  CDS Start-End: 1878-3719
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtggactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171048 - DNA, 2853 bp, Homo sapiens
  Payload ID: 13653
  Gene Symbol: PPP1R18
  Gene Name: protein phosphatase 1, regulatory subunit 18
  ENST ID: ENST00000435929
  CDS Start-End: 132-1973
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccaggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171049 - DNA, 2853 bp, Homo sapiens; identical to SEQ ID NO: 171046
  Payload ID: 13653
  Gene Symbol: PPP1R18
  Gene Name: protein phosphatase 1, regulatory subunit 18
  Uniprot ID: Q6NYC8
  ENST ID: ENST00000449705
  CDS Start-End: 132-1973

SEQ ID NO: 171050 - DNA, 4599 bp, Homo sapiens
  Payload ID: 13653
  Gene Symbol: PPP1R18
  Gene Name: protein phosphatase 1, regulatory subunit 18
  ENST ID: ENST00000412189
  CDS Start-End: 1878-3719
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccaggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171051 - DNA, 2853 bp, Homo sapiens; identical to SEQ ID NO: 171046
  Payload ID: 13653
  Gene Symbol: PPP1R18
  Gene Name: protein phosphatase 1, regulatory subunit 18
  Uniprot ID: Q6NYC8
  ENST ID: ENST00000451544
  CDS Start-End: 132-1973

SEQ ID NO: 171052 - DNA, 2853 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000438945
  CDS Start-End: 132-1973
cctccctccagtctccggatctccctcggtccctctctcctcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctcctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171053 - DNA, 4599 bp, Homo sapiens; identical to SEQ ID NO: 171044
  Payload ID: 13653
  Gene Symbol: PPP1R18
  Gene Name: protein phosphatase 1, regulatory subunit 18
  Uniprot ID: Q6NYC8
  ENST ID: ENST00000443517
  CDS Start-End: 1878-3719

SEQ ID NO: 171054 - DNA, 4599 bp, Homo sapiens; identical to SEQ ID NO: 171044
  Payload ID: 13653
  Gene Symbol: PPP1R18
  Gene Name: protein phosphatase 1, regulatory subunit 18
  Uniprot ID: Q6NYC8
  ENST ID: ENST00000437121
  CDS Start-End: 1878-3719

SEQ ID NO: 171055 - DNA, 1111 bp, Homo sapiens
  Payload ID: 13653
  Gene Symbol: PPP1R18
  Gene Name: protein phosphatase 1, regulatory subunit 18
  ENST ID: ENST00000435006
  CDS Start-End: 1-231
cttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171056 - DNA, 4599 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000455935
  CDS Start-End: 1878-3719
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctcctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171057 - DNA, 4599 bp, Homo sapiens; identical to SEQ ID NO: 171056
  Payload ID: 13653
  Gene Symbol: PPP1R18
  Gene Name: protein phosphatase 1, regulatory subunit 18
  Uniprot ID: Q6NYC8
  ENST ID: ENST00000438815
  CDS Start-End: 1878-3719

SEQ ID NO: 171058 - DNA, 1111 bp, Homo sapiens; identical to SEQ ID NO: 171055
  Payload ID: 13653
  Gene Symbol: PPP1R18
  Gene Name: protein phosphatase 1, regulatory subunit 18
  ENST ID: ENST00000455026
  CDS Start-End: 1-231

SEQ ID NO: 171059 - DNA, 2853 bp, Homo sapiens; identical to SEQ ID NO: 171052
  Payload ID: 13653
  Gene Symbol: PPP1R18
  Gene Name: protein phosphatase 1, regulatory subunit 18
  Uniprot ID: Q6NYC8
  ENST ID: ENST00000444206
  CDS Start-End: 132-1973

SEQ ID NO: 171060 - DNA, 4597 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000615527
  CDS Start-End: 1878-3719
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtggctatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttc

SEQ ID NO: 171061 - DNA, 1448 bp, Homo sapiens
  Payload ID: 13653
  Gene Symbol: PPP1R18
  Gene Name: protein phosphatase 1, regulatory subunit 18
  Uniprot ID: Q6NYC8
  ENST ID: ENST00000615892
  CDS Start-End: 71-568
cccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 171062 - DNA, 3137 bp, Homo sapiens
  Payload ID: 13654
  Gene Symbol: PPP1R21
  Gene Name: protein phosphatase 1, regulatory subunit 21
  Uniprot ID: Q6ZMI0
  ENST ID: ENST00000281394
  CDS Start-End: 186-2495
ccaccttcctcccaccccgggaacccggaagtggaggaggaggcgcggcggcggcggcggcggcggctgcggtggccaagcaggcagatactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctagttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatatttctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcaca

SEQ ID NO: 171063 - DNA, 3142 bp, Homo sapiens
  Payload ID: 13654
  Gene Symbol: PPP1R21
  Gene Name: protein phosphatase 1, regulatory subunit 21
  Uniprot ID: Q6ZMI0
  ENST ID: ENST00000294952
  CDS Start-End: 158-2500
aagtggaggaggaggcgcggcggcggcggcggcggcggctgcggtggccaagcaggcagatactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatatttctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcaca

SEQ ID NO: 171064 - DNA, 743 bp, Homo sapiens
  Payload ID: 13654
  Gene Symbol: PPP1R21
  Gene Name: protein phosphatase 1, regulatory subunit 21
  ENST ID: ENST00000455978
  CDS Start-End: 1-349
acacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaattttgcagagggcaagcaggtccacagagctcctcacgctgacatggcagaagcagaactctgtgatatttgggtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacag

SEQ ID NO: 171065 - DNA, 2481 bp, Homo sapiens
  Payload ID: 13654
  Gene Symbol: PPP1R21
  Gene Name: protein phosphatase 1, regulatory subunit 21
  ENST ID: ENST00000431614
  CDS Start-End: 183-344
cgttccaggtcgccatcttggaccatgagtcaagatggcgccccctggtcccaggggcacagcccaggcacgctagcgaggctacgcacgcacgtattcggcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaaggattgtttgagaatggtgaacacatagaagagacaagcttctaagatgatagagaatctgtgtaccttaggatgtttctctaaaggatgaaagttatgtggacataacttattctttccatcagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaag

SEQ ID NO: 171066 - DNA, 545 bp, Homo sapiens
  Payload ID: 13654
  Gene Symbol: PPP1R21
  Gene Name: protein phosphatase 1, regulatory subunit 21
  ENST ID: ENST00000421486
  CDS Start-End: 424-545
tcccctcagccgtctccgtccaccattacggtgcctccacctgcagctcccaggagatggggccgggcggtgtctgcgtccgtgagcgtttttgcagggagaagctggagtttgattcttccttttcactgaagtagcgggcttgggactgggatgtcagaaattctggcttcttgcctctaatgctggctgagaagggaagggaaaggtgtggaccactcctcacctcgctgcttcctcaattttctcagcctagggatggggaagatcaacccttctcccctcccacagggatgatatgaggttaaagagatttatcttcccccgaatcaattcgagaggcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgagg

SEQ ID NO: 171067 - DNA, 3208 bp, Homo sapiens
  Payload ID: 13654
  Gene Symbol: PPP1R21
  Gene Name: protein phosphatase 1, regulatory subunit 21
  ENST ID: ENST00000416913
  CDS Start-End: 186-350
ccaccttcctcccaccccgggaacccggaagtggaggaggaggcgcggcggcggcggcggcggcggctgcggtggccaagcaggcagatactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaagctaaactgtgaggaccaatctgttttcactttgatataggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatatttctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcac

SEQ ID NO: 171068 - DNA, 3049 bp, Homo sapiens
  Payload ID: 13654
  Gene Symbol: PPP1R21
  Gene Name: protein phosphatase 1, regulatory subunit 21
  Uniprot ID: Q6ZMI0
  ENST ID: ENST00000449090
  CDS Start-End: 186-2402
ccaccttcctcccaccccgggaacccggaagtggaggaggaggcgcggcggcggcggcggcggcggctgcggtggccaagcaggcagatactgcctgacccgttcccgggagcgtgtctgggtttgggggcgggagacaggctgagccgcctgggcggcctggcctgtacggggcgggggaggccatggcctcggctgagttgcaggggaagtaccagaagctggctcaggagtactcgaagcttcgggctcagaatcaggttctgaaaaaaggtgttgtggatgaacaagcaaattctgcagctttaaaggagcaactgaaaatgaaggatcagtcattgagaaaactacaacaggaaatggacagtttgacatttcgaaatctgcagcttgccaagagggtagaactacttcaagatgaactagctctaagtgaaccacgaggcaagaaaaacaagaaaagtggagaatcttcttctcagttgagtcaagagcagaagagtgtctttgatgaagatctgcaaaagaagatagaagagaatgaacggttgcatatacaattttttgaagctgatgagcagcacaagcatgtggaagcagagctgaggagtcgactggccactctggagacagaagcagcccagcaccaagctgtggttgacggtctcacccggaagtacatggaaaccattgagaagctgcagaacgacaaggctaaactagaagtgaaatctcagactctagaaaaggaagccaaggaatgtcgacttcgaacggaagaatgtcaattacagttaaagactcttcatgaagatttgtcaggtagattagaggaatccttatcaatcatcaatgaaaaagtaccttttaatgatacaaaatatagtcagtacaacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaaggttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctagttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatatttctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcacactttc

SEQ ID NO: 171069 - DNA, 4932 bp, Homo sapiens
  Payload ID: 13655
  Gene Symbol: PPP1R26
  Gene Name: protein phosphatase 1, regulatory subunit 26
  Uniprot ID: Q5T8A7
  ENST ID: ENST00000356818
  CDS Start-End: 550-4179
gcgcggcccgggcgcggggcggcggcagcggcggcgcgcggggaggcggggaggcggggggcccggccggacgcccctgcgccccctccccgcgccccggccgagggcggagcgcgctggccctgcagcctccggcccgcccccggcccgccgcctcccccgggacgtgggacgcgggcgcaggcggggtccgcgcggcgggcggcgggggacgggcggagtcaaaagtctattgaaaaagcagagagagaatgcctcggtgtgtaagtggagtgatgaggacctgatctctgggccgtgtgggaacactggctgccatttcatcacagtcaacctggactcacagaatttcaagagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcaacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagcctgccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 171070 - DNA, 4769 bp, Homo sapiens
  Payload ID: 13655
  Gene Symbol: PPP1R26
  Gene Name: protein phosphatase 1, regulatory subunit 26
  Uniprot ID: Q5T8A7
  ENST ID: ENST00000401470
  CDS Start-End: 387-4016
ctggttaaccggagaaagctcctggtaaagaagaatccataacagaggcaaaacatactggccagttttcgcccactgctgaggtcctgagggcagccacagcctctgagccaaggggagttcagtgtccataagccttggaggcttgcttgcacaagaaccgctttgcactgcaattttggggtaggcaggagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcaacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagcctgccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 171071 - DNA, 4640 bp, Homo sapiens
  Payload ID: 13655
  Gene Symbol: PPP1R26
  Gene Name: protein phosphatase 1, regulatory subunit 26
  Uniprot ID: Q5T8A7
  ENST ID: ENST00000604351
  CDS Start-End: 258-3887
attcccatgatgcccagccacgggcacggcttccggagtgcggccgccgccgccaccgtccggagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcaacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagcctgccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 171072 - DNA, 4502 bp, Homo sapiens
  Payload ID: 13655
  Gene Symbol: PPP1R26
  Gene Name: protein phosphatase 1, regulatory subunit 26
  Uniprot ID: Q5T8A7
  ENST ID: ENST00000605660
  CDS Start-End: 120-3749
ttggcagctatcgctgtttgtagctgcatcatgcccatgtgctttctttccgcccaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcaacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagcctgccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 171073 - DNA, 4744 bp, Homo sapiens
  Payload ID: 13655
  Gene Symbol: PPP1R26
  Gene Name: protein phosphatase 1, regulatory subunit 26
  Uniprot ID: Q5T8A7
  ENST ID: ENST00000605286
  CDS Start-End: 362-3991
cacagcagaagcagaaacagcagcggcctcaagtcaaaagtctattgaaaaagcagagagagaatgcctcggtgtgtaagtggagtgatgaggacctgatctctgggccgtgtgggaacactggctgccatttcatcacagtcaacctggactcacagaatttcaagagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcaacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagcctgccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 171074 - DNA, 782 bp, Homo sapiens
  Payload ID: 13656
  Gene Symbol: PPP1R27
  Gene Name: protein phosphatase 1, regulatory subunit 27
  Uniprot ID: Q86WC6
  ENST ID: ENST00000330261
  CDS Start-End: 81-545
ctgatctggtcgggaccggatacattattaaccccagtgcagtagggtccccaggggcaacctgccccacagcgcccaagatgcctagcagaactgcccgctatgcccgctacagcccacggcagcggcggcggcggatgctggctgatcgcagcgtgcgtttccctaatgatgtcctgttcttggaccacatccggcagggtgacctggagcaggtggggcgcttcatccggactcggaaagtctccctggccaccatccacccctcaggcctggccgccttgcatgaagccgtgctctctggaaacctggaatgcgtgaagctgctggtcaaatacggggctgacattcaccagcgagatgaggcgggctggacacccctgcacattgcctgcagcgatgggtaccctgacatagccaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacacacgtgg

SEQ ID NO: 171075 - DNA, 1443 bp, Homo sapiens
  Payload ID: 13656
  Gene Symbol: PPP1R27
  Gene Name: protein phosphatase 1, regulatory subunit 27
  ENST ID: ENST00000570394
  CDS Start-End: 98-442
cgacaggagccctcaagctgatctggtcgggaccggatacattattaaccccagtgcagtagggtccccaggggcaacctgccccacagcgcccaagatgcctagcagaactgcccgctatgcccgctacagcccacggcagcggcggcggcggatgctggctgatcgcagcgtgcgtttccctaatgatgtcctgttcttggaccacatccggcagggtgacctggagcaggtggggcgcttcatccggactcggaaagtctccctggccaccatccacccctcaggcctggccgccttgcatgaagccgtgctctctggaaacctggaatgcgtgaagctgctggtcaaatacggggctgacattcaccagcgagatgaggcgggctggacacccctgcacattgcctgcagcgatgggtaccctgacatagccaggtgagggggccctgggtctacacaggcttgaacccgacccctccgggcctcagtgggtccccaggatgggagccccaaaatgtagcccgggtggtgtcggcaagaaccctagaggctgggggcggtggctcacgcctgcgcctgtaatcccagcactttgggaggccgaggtgggcggatcacctgaggtcaggagttcgtgacaagaaccctctcactactaaaaatacaaaattagccacgcgtggtggcgcgcgcctgtaatcccagctactcaaggctgaggcaggagaatcacttgaacccgggaagtggaggttgccgtgagtcgagatcatgccattgcactccagcctgggtgataagagcgaaattctgtctcaaaaaacaaaaaaaacaaaaaaagaaccctgcaaaccctagaggcttctggaatcctgtttctgcctttgtcctcaatagaaccaacttgaaaagctggccacagcttccaaagggtcaggtttcttcctcctcaccctacccggaccttaggaccccaaggtgggggacacacaggtgaccccaggactctggccctctgacccgggttggggcgagcactctcctggctcctccccgcttcagccagagcgacctttacaccccaggtaccttatctccctgggagcggacagggatgcaaccaacgacgatggcgacctgccctccgacctcatcgacccggactacaaggagctggtggagctcttcaaagggaccacgatggactgagccagctttgcccgcccgcccccgcgcccagggccgcctccctggagaagccgcgcgtcgcccatgggccagcacgtgccccacccgtgggccaggggcggccggacccgtccctccacgaccccgccacccctcctaggcctggctttgtccccaggtgaattttttactgtgacactttttactttttcaataaacgtgactcccaggtgagggggcctgggtctacac

SEQ ID NO: 171076 - DNA, 1535 bp, Homo sapiens
  Payload ID: 13657
  Gene Symbol: PPP1R32
  Gene Name: protein phosphatase 1, regulatory subunit 32
  Uniprot ID: Q7Z5V6
  ENST ID: ENST00000338608
  CDS Start-End: 126-1403
gtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcaccgcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacaggccctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagagaa

SEQ ID NO: 171077 - DNA, 1472 bp, Homo sapiens
  Payload ID: 13657
  Gene Symbol: PPP1R32
  Gene Name: protein phosphatase 1, regulatory subunit 32
  Uniprot ID: Q7Z5V6
  ENST ID: ENST00000432063
  CDS Start-End: 126-1343
gtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcaccgcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccaccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacaggccctccctggggaccctggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcaga

SEQ ID NO: 171078 - DNA, 533 bp, Homo sapiens
  Payload ID: 13657
  Gene Symbol: PPP1R32
  Gene Name: protein phosphatase 1, regulatory subunit 32
  ENST ID: ENST00000535545
  CDS Start-End: 1-414
ggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaaggaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagca

SEQ ID NO: 171079 - DNA, 488 bp, Homo sapiens
  Payload ID: 13657
  Gene Symbol: PPP1R32
  Gene Name: protein phosphatase 1, regulatory subunit 32
  ENST ID: ENST00000366212
  CDS Start-End: 189-356
gaggagacatgcatgtggctgcagccagttagcgagagctgttaggtaatgcgcaaagagaaagggatcgcgagggctgcagtgcgcacgggtcggatttgaaatcggtggccttgagcaggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcagagaa

SEQ ID NO: 171080 - DNA, 594 bp, Homo sapiens
  Payload ID: 13657
  Gene Symbol: PPP1R32
  Gene Name: protein phosphatase 1, regulatory subunit 32
  ENST ID: ENST00000542951
  CDS Start-End: 1-531
ccctcacaggccctccctggggaccctgccctcctcccaggccagagtgtcaccaagtcagacttcctccccaagactcacctacatgtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccac

SEQ ID NO: 171081 - DNA, 1107 bp, Homo sapiens
  Payload ID: 13657
  Gene Symbol: PPP1R32
  Gene Name: protein phosphatase 1, regulatory subunit 32
  ENST ID: ENST00000538185
  CDS Start-End: 671-979
gccgtttgttgtcctctggcctaaaccctgaggctcagaggggaggagcagagcttccgcccgcacagcagactcagcacagtggccgctccagttcccacggaggtgggggaggggcaacgatgttctgaccccttcttaggcaaacacctcctcctgtggctctggcagagaccagctccagtcctgtctgctgggtccttccagcctgtcgtgtcctgttgtgtcctgagctcctgctggctgtcaggcacgcttgctggtgcttcctggtgcgcgcagagccccgggattgtcatcactgattcctgcattgatctgtctgcaccccctcttcataagttcaagggtgggacccccttcttacttgtctttgcaccctctggacctggctgtgctcagtgaaatggaaggaaatggaaatgaaatggaaggaaagttaagtgcctagagaagtggatgagacggggtccccaccccaaggtactggcaggccagggacaggggcatcactgaaactgtcctttaacactccaaagagtgtttcagcgtcaggtggaggggagggcaggctttttgagtaagagttcccccagtggacgtgggcttagggagagctagacgaggacagcatgagcaaaggtggggaggctgggcgatctgagggtcgatggagaagggcagcaggggttgcagaggtgggcagagtccagcttccagccaaggacccctcctctcctccaggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcag

SEQ ID NO: 171082 - DNA, 1031 bp, Homo sapiens
  Payload ID: 13658
  Gene Symbol: PPP1R35
  Gene Name: protein phosphatase 1, regulatory subunit 35
  Uniprot ID: Q8TAP8
  ENST ID: ENST00000292330
  CDS Start-End: 192-953
ggaaatgacgcctgggagcgacaacagggtgggtggggctgctgactccgcccccgaaggaaagggttaacggtttccggtagcggcgtctaggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgaggggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaa

SEQ ID NO: 171083 - DNA, 1405 bp, Homo sapiens
  Payload ID: 13659
  Gene Symbol: PPP1R36
  Gene Name: protein phosphatase 1, regulatory subunit 36
  Uniprot ID: Q96LQ0
  ENST ID: ENST00000298705
  CDS Start-End: 97-1365
agcgacgccccgccccgctccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaaggtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggtaggccttgtagagaaaaaagaaatggaattggttttaagtgaattagaagcagcacagaggtacttggcgcagaagtactgtatccttgtgctgggcttggccgtgccggataagcatcacatgtgctgtggaaaggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatctcaagtaaactactttgacttt

SEQ ID NO: 171084 - DNA, 1400 bp, Homo sapiens
  Payload ID: 13659
  Gene Symbol: PPP1R36
  Gene Name: protein phosphatase 1, regulatory subunit 36
  ENST ID: ENST00000467261
  CDS Start-End: 59-196
gtgcaggcgcctgcgggcggtatcctcggcgacgccgtatggcttccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaagatgaagaaacaaggctcagggagattaagcaactgaaccaaagtcatacagccagtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggtaggccttgtagagaaaaaagaaatggaattggttttaagtgaattagaagcagcacagaggtacttggcgcagaagtactgtatccttgtgctgggcttggccgtgccggataagcatcacatgtgctgtggaaaggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatct

SEQ ID NO: 171085 - DNA, 576 bp, Homo sapiens
  Payload ID: 13659
  Gene Symbol: PPP1R36
  Gene Name: protein phosphatase 1, regulatory subunit 36
  ENST ID: ENST00000555645
  CDS Start-End: 79-303
tccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaaggtttgccgcagaagattctgtccagtggctcctgaaacatcaccctcatgcccctattccaaagctggcagagaaccagcagtctgcctgaatgtttgccaaggtcatggactcccctgaggacataaaaccaaggaaaccctactctttcgtcatggcctgagagaagactctctgagaaccatcaaagaggtctaacttgtgtggaagccaagagtggtccagccctctgcatttacgtgatggattctagagagaaaatatgaatttctttcctgtttacttcaagttttacacctgcagcagaagtcaaggaaaaaggaaagaaaggcaaagcagttcactttgcagaaactgatggtcc

SEQ ID NO: 171086 - DNA, 596 bp, Homo sapiens
  Payload ID: 13659
  Gene Symbol: PPP1R36
  Gene Name: protein phosphatase 1, regulatory subunit 36
  ENST ID: ENST00000557202
  CDS Start-End: 463-596
gccatatttgcctagaaaaaaaaaaaactctggtgtatttgacagatggtcagaattgaattctggctccctgcgcagcagttgggattacgattagggatgtggtactggaaagatgaaaccagaactcttgaattcagaagatgaagaaacaaggctcagggagattaagcaactgaaccaaagtcatacagccagtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggt

SEQ ID NO: 171087 - DNA, 3163 bp, Homo sapiens
  Payload ID: 13660
  Gene Symbol: PPP1R37
  Gene Name: protein phosphatase 1, regulatory subunit 37
  Uniprot ID: O75864
  ENST ID: ENST00000221462
  CDS Start-End: 365-2440
gcagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatgcccagaatgtgaccgtggacgaggtcatcggcgcctacaagcaggcctgccagaagctgaactgcaggcagatccccaagctcctcaggcagctgcaggaattcacagacctcgggcaccgcctcgactgtctggacctgaaaggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcgccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtctggcctacatctgcgagggcctcaaggagcagaggaaggggctggtgaccctggtgctgtggaacaaccagctcacgcacacaggcatggccttcctgggcatgacactgccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccctccacacccaccgagcagcggatttccgtgtccagcccgggccggggccacaaggtgtttgtggtgacccgggtggagagcccgcccgagagggcagagccccctgcgtcccccacccctccctctcccccaccccctccctccccacccgcctcaccttccctaccaccagccggggccattgacacccgggacacagggtcctctgagcctcagccaccaccggagccgcctcggtcagggccaccactgcccaacggcctgaagcccgagttcgccctggcactgccccctgagccgcccccggggcctgaggtcaaggggggcagctgcggcctggagcacgaactgagctgctccaagaacgagaaggagctcgaggagctgcttctggaagccagtcaggaatccgggcaggagacactgtgacactttagttccctttttccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcacagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttcactttg

SEQ ID NO: 171088 - DNA, 712 bp, Homo sapiens
  Payload ID: 13660
  Gene Symbol: PPP1R37
  Gene Name: protein phosphatase 1, regulatory subunit 37
  ENST ID: ENST00000544069
  CDS Start-End: 153-712
gcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggtgagaagcttgactacaagacctgtgaggccctggaagaggtcttcaagaggctgcagttcaaggtcgtggacctggagcagacaaacctggatgaagatggtgcctcggccctcttcgacatgatcgagtactacgagtcggccacccacctcaacatctccttcaacaagcacatcggcacccggggctggcaggcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcc

SEQ ID NO: 171089 - DNA, 4384 bp, Homo sapiens
  Payload ID: 13661
  Gene Symbol: PPP1R3A
  Gene Name: protein phosphatase 1, regulatory subunit 3A
  Uniprot ID: Q16821
  ENST ID: ENST00000284601
  CDS Start-End: 70-3438
gcctcagtatctcaaatgtcagcctctactagtcgtacagttctctcttatttgatatcagagagcccaatggagccttctgaagtacctagtcagattagcaaagataattttttagaagttcctaatttatctgactctctttgtgaagatgaagaagttactttccaacctggtttctcccctcaaccaagtagacgaggttctgattcttctgaagacatatacctggataccccatcttcaggtactagaagagtttcatttgctgattcctttggattcaatcttgtgtctgttaaagaatttgattgctgggaattaccgagtgcttcaaccacttttgacttagggacggacattttccacacagaagaatatgttttagccccactgtttgacttgccttcttcaaaagaagatcttatgcaacaactccaaatacagaaagcaatactggagtcaactgagtctcttcttgggtctacaagtatcaagggtattattcgagttttgaatgtttcttttgagaagttagtatatgtaagaatgtctttagatgactggcagacacattatgacattttagcagaatatgttcctaattcatgtgatggtgaaactgaccagttctcctttaagattgtattggttcctccttatcaaaaagatggcagtaaagttgagttttgtatacgttatgaaacttctgttggtacattttggtcaaataataatggcacaaattatacattcatttgtcaaaagaaagaacaagagccggagcctgtaaaaccatggaaagaagttcctaacagacaaataaaaggctgcttaaaggtaaaatcaagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacagtgcaaataccttgcccctcttcagatcaactaatggcaggaaaccttaataaaaaacatgaaggaggagctaaaaatattgaagtaaaagatttgggatgtttacgaagagatttccattcagatacgtcggcatgtctcaaagaatcaacagaagaaggatcttctaaggaagattattatggcaatggtaaggatgatgaagaacaaagaatatatttaggtgttaatgaaaaacaaagaaaaaatttccaaacaatcttacatgaccaagaaaggaagatgggtaaccctaaaataagtgtggcagggattggagctagtaacagagacctggctactctgctgagcgaacataccgcaatccccacccgggcaatcacagcagatgtgtctcattcaccaaggacaaatttaagttgggaagaagctgtgttaaccccagagcatcatcatttgactagtgaaggcagcgctttaggagggataactggtcaagtttgttcatcaagaactggaaatgttttgaggaatgattatcttttccaagttgaagaaaaatcaggtgggattaattctgaagatcaggataatagcccacagcataaacaaagttggaatgttctggaaagtcagggaaaatcaagagagaataagacaaacataacagagcatatcaaaggacaaacagattgtgaagacgtgtggggaaaaagagataatacgaggagtttgaaagctactacagaagaattgtttacctgccaagaaacagtgtgctgtgaactgtcttctctagctgatcatggcattactgagaaagcagaagctggtacagcctatataattaagacaacatcagaaagtactccagaaagcatgtctgctagagaaaaagcaataattgctaagctacctcaagagacagcacgaagtgacaggcccatcgaggtaaaggaaacagcgtttgatccacatgaagggagaaatgatgattcacattataccctttgtcaacgagatacagtaggtgtaatctatgacaatgattttgaaaaggaatcacgtttaggtatttgtaatgtacgtgtagatgaaatggagaaggaagaaaccatgtctatgtacaatcctaggaagacacatgacagggagaaatgtggcactggaaatataacatctgtggaagaatcctcatgggtcattacagaatatcaaaaagcaacttcaaaactggatttacagttgggaatgttaccaacagacaaaactgtattttcagaaaacagagatcttaggcaggttcaagaattatcaaagaaaacagactcggatgccattgtgcattctgcttttaactcagacactaatagagctcctcagaatagctctcctttttccaaacatcatactgaaatttcagtgtcaactaatgagcaggcaattgctgtagagaatgcagttactaccatggctagccaacctatttctacgaaatcagaaaatatttgtaattcaacaagagaaatccagggtattgagaagcacccttatcctgagtctaaacctgaagaagtttccagaagttcaggaatagtgacatcaggtagtagaaaagaaagatgcataggccagattttccaaacagaagagtatagtgtggaaaaatctctagggccaatgattttaatcaacaaacctcttgagaatatggaagaagcaaggcatgaaaatgaaggattagtaagctctgggcaatcactatacacttcaggtgaaaaggaatctgacagctctgcttctactagtcttcctgttgaggaaagtcaagctcaaggcaacgaatctttgttttcaaaatataccaactctaaaataccttatttccttttgtttctgatatttcttataactgtctaccattatgacttaatgattggcttgacattctacgttttgtcattgtcctggctatcctgggaagagggtagacaaaaagagtctgtcaaaaagaagtaacctcagcactactattctctcttaaaagataagctatttaaccccaaacatttggattggtgaatgggactattcattgttcaaagatccagtgcagtttttctcttgaaggatcatttaaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgttcaatttatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaacaattgggagattatctttcaattctgaaaaattctgtgggtggcctgtctttaagcaatgcttttctcttgtgagggaagactgtaacacagctgaactatttcagtgtcaactattcagaattgaaaatgtaaattaaaatttccacaagcattgcttcagaatgaatttgtacctataaagcataaggcattaaatgacaataaaaattccaaatggactatttgttccacattgtatttttgtcttcaaatattttctaagagaatgaattatccccc

SEQ ID NO: 171090 - DNA, 800 bp, Homo sapiens
  Payload ID: 13661
  Gene Symbol: PPP1R3A
  Gene Name: protein phosphatase 1, regulatory subunit 3A
  Uniprot ID: Q16821
  ENST ID: ENST00000284602
  CDS Start-End: 1-225
atggagccttctgaagtacctagtcagattagcaaagataattttttagaagttcctaatttatctgactctctttgtgaagatgaagaagttactttccaacctggtttctcccctcaaccaagtagacgaggttctgattcttctgaagacatatacctggataccccatcttcagaaagaacaagagccggagcctgtaaaaccatggaaagaagttcctaacagacaaataaaaggctgcttaaaggtaaaatcaagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgata

SEQ ID NO: 171091 - DNA, 1049 bp, Homo sapiens
  Payload ID: 13661
  Gene Symbol: PPP1R3A
  Gene Name: protein phosphatase 1, regulatory subunit 3A
  ENST ID: ENST00000449795
  CDS Start-End: 477-1049
gagtttaagttatgaaagatggtggctttcatttaggtctctggatctctctctctatcactttatctgccaagctgctgtgttttaagcagccctctagagagacttttatggtaaggaagtatagtattatactatctggccaatagccagagaagaattgagatctcccaacaaccatgtgactgaacttggaagcagacccttctttcccagctgaatcttcttgagatgtctggagccctggctaacagcttaataacctcaagagagaatctgggcaagaacgactcagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacagtgcaaataccttgcccctcttcagatcaactaatggcaggaaaccttaataaaaaacatgaaggaggagctaaaaatattgaagtaaaagatttgggatgtttacgaagagatttccattcagatacgtcggcatgtctcaaagaatcaacagaagaaggatcttctaaggaagattattatggc

SEQ ID NO: 171092 - DNA, 5548 bp, Homo sapiens
  Payload ID: 13662
  Gene Symbol: PPP1R3B
  Gene Name: protein phosphatase 1, regulatory subunit 3B
  Uniprot ID: Q86XI6
  ENST ID: ENST00000310455
  CDS Start-End: 152-1009
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatgggggtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaa

SEQ ID NO: 171093 - DNA, 2334 bp, Homo sapiens
  Payload ID: 13662
  Gene Symbol: PPP1R3B
  Gene Name: protein phosphatase 1, regulatory subunit 3B
  Uniprot ID: Q86XI6
  ENST ID: ENST00000519699
  CDS Start-End: 246-1103
aaagttaaagggggcagcgcggccgcggggagctcgagtcccgggtgactgctggagggaggaggtgaccgcgcagctctcgtgcacggacggacttcgccgcccgcggggggcgcgaacccgagcccgggcccagctcctgccgtcacggcagctgtccctgttcccccagggcgtatgctgccgcgggctggcgcgtctgccctcgggacttatgagctgaacccgcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgtgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagcttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaac

SEQ ID NO: 171094 - DNA, 2524 bp, Homo sapiens
  Payload ID: 13663
  Gene Symbol: PPP1R3C
  Gene Name: protein phosphatase 1, regulatory subunit 3C
  Uniprot ID: Q9UQK1
  ENST ID: ENST00000238994
  CDS Start-End: 86-1039
gccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggagaactgctcgttgcaagagcgaacagtgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtgtttttaagttggttttacaattctttcctggggaaattatttctggaggggaaaaagatccattctacgtatccttgtggagaaaagctaaataacctttaagaatgtgggtggtattggagaaagaagatgaattatagctccggagaatcaagatcttaagtgaagcctttctgttcagatgtgatctataaaaaatcataatttggggaaagtttaagcaaatctggctttgtagtcctgatgttataagtgactttgtgatcaaactgtcaggcttgggttcttgttatagaatgcttggtatagaaaaaccatgccatcattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggtccactctgtacacaggcattcctcctgcaataatgttgtatctttgagaccgttgtcagtgtacacaactcacatccttcatattgaaggtgactcatttttctgcacacttttttgatgtgatgcttgacgtgaggcccgacactaggattctcaatgcaagaatccagtaccttgcacatagaagtagcaacccatcccttgcctattttcatcttgctgttttcttttttttaaaaaaatggatgtgacttgttttgaatgttttgtattatacttgtttttgtgtgtgcataaattcattctgtaggatcttaagaaaaagagtcccagaatgttgcttctattattgtgcacaaccattgagaggtgttacaagaatgcagttaattttaacatgtgtgatgtgccatggtggaaaagtactatcggaataactctgcagtgacagaatttgaagtttggctagcatccatacttttctactgtaaatatttcactctcctctagctatccttgatgagcttctcactttaagaataaatgtgtttgatataa

SEQ ID NO: 171095 - DNA, 3630 bp, Homo sapiens
  Payload ID: 13664
  Gene Symbol: PPP1R3D
  Gene Name: protein phosphatase 1, regulatory subunit 3D
  Uniprot ID: O95685
  ENST ID: ENST00000370996
  CDS Start-End: 367-1266
aagtaacgccgcggaccgggaaagtgggaggggccgctcccggaacgcagccttcttgtaagaacctccaaggaagcaagaagaaaaaagaggcgctaccctgcgctcccgggaggcctctgaaagcttccactagagaaaaactccccactcttacaatttctttaaccgcaagaagcggaggacctggacaaggactcgaggagcaaggtggcgaaccaagggtagggcgcaccgggcccgagaggtcccccgcaggttgcagatacggtggactctctgcggcttctgagcacggagggagctgtcgcggggtcgggaggtcgtctctcatccctgcctcatcttccgacggccggcggggccatgtccagaggcccgagctccgcggtcctgcctagcgccctgggatcccggaagctcggcccccggagcctcagctgcctgtcggacctggacggcggcgtggccctggagccgcgggcctgtaggccccctgggagcccgggccgcgcgccgccgccaacgccagcgccgtcgggctgcgacccccgcctgcggcccatcatcctgcggcgggcgcgctcactgcccagctcccccgagcgccgccagaaggccgcgggcgcgccgggcgctgcgtgtcggccgggctgcagccagaagctccgcgtgcgcttcgccgacgccctgggcttggagctggcacaggtcaaggtgttcaacgcgggagacgacccgtccgtgccgctgcacgtgctgtcgcggctcgcaatcaactcggacctgtgctgcagcagccaggacctggagttcaccctgcattgcctggtgcccgatttcccgccgcccgtcgaggccgccgactttggcgagcgcctgcagcggcagctcgtgtgcctggagcgtgtcacttgctcggaccttggcatcagcggtacggtgcgcgtgtgcaacgtggccttcgagaagcaggtggctgtgcgctacactttctcgggctggcgcagtacccacgaggcggtggcgcggtggcgcgggcccgcaggccccgagggcacggaggacgttttcaccttcggctttccagtaccgcccttcctgctggagctcggctcccgcgtgcacttcgcggtgcgctaccaagtggcgggtgccgagtactgggacaacaacgaccaccgagactacagcctcacatgtcgcaaccacgcgctgcacatgcctcgcggggagtgcgaagagagctggatccacttcatctgagccgcgcggggaccggccacctggagcctccacacctaagctgcgcctcctgtcatttccctgctgggctctcacatctatctggttgttcttcaccaccctccaagtcctctgacctaattttctgctgcaaggtcccctggcagtggcccatcctgtcttctacttgaaacgtctgagtcacttggtctaaaaagtagcctcaggtggccagaaggccgagttgtgtaatgagttggggcagggtggtggggtaggtgcatgggagggtgggccctctggggaggcccaagcagcttgttttgcaaaggcccaagtcctcctgctaggaaaagcttttgcatgtgtcctgaatgtgtctctgtaaacatagctgttatttattattgtgatgttgggacctttagcccatagcggatgcctcctcaggaatattctcgatttaataagctaaaaaaaaaaagttctgtgtttgtgcccacagtaaacagaatgtacagtgtgacccacatcgtggtccctccaggcattcctgccccaggataaggaaaacctgagcccacatctgattgccaacggctgtagccttctaacagtgggaaactattaataggcaagaaatttctgctttatcagtcatcacacaaccattcctgggcattgagactgtcctggttaggctgtgtgtctcctacattaacagctggggaggagggaaaagcttcagacttttaaactagcaaaacagttatttctctgcattcacaattctgatttcatgtatttctctgtacatgtttgatcattatcaggccattctgtttaagtttgaaactaagcattttaagaagtcttgcctcagttatttcagttttcaggtgactagagaatttcaggcaacagtgccctttgcaattacctttttgatgattaaggtgactatttttatttcttgttaagcatcagaagatgtcagcattcatcttttgggagtccagttacaaggtggaactagaaggtgttttcagcaatagccagagcactggaggaaaaataattgacaaatatttatacttttaaattgttttgaactgtatttacatacatcatgttttatcaggtacccaccaactttatactttctgccttcagatagagtttctaacattttctagtttgtcagttttaaaatataaaattcttttatgtttttaaaccgtcaaccaagaagtcaagaccactgtcccctgctgagttaggcaatcacttaaaactccaaagaactccaggctgaggagttcttttggtgctgaacagtggtctgacaacaggtgctagaattaaggtgtgggaaaaaaaaaaaaacagccaggaaggacaagatctccaatttgtgaagcttatgatacagctgaaaccagtctgatcaattttatgctacctgtcaccaagaaattaactctaaatttttgaatgcttgttggcatctgtcaaatcaatactgaaaggatgcatttcggcttttaaccagtttggttctgatcattgcaacctctgtgcttttataattcaaagaacaaggatagctttcttcggtatcttttaatataagaacactgaattttggcttgaaatattgtgactaaattgcacaatctctggctattagcactgttcactacattaacatgcaagagagagagaagccttgttacatttcctgctatttaacaaactgtccaattaggtcagcaagcctgttagggccttcactgctacgcccctggccccaaaacagagagcaagacagttgtccagagaatttagatatgagttaagagctgccagatttattttaaggcatgtagagaatctcataatctatgtgaaagtcacttgccaaaaaggttttggttatgaaagtgaatgttatatatttaatattaagtgaacctcccgtgccttttaaaaaataccaacattatgaaatttaaaagcttaaatatatttgcctagttgataaagaggctgtggaacaactgaaggagaactttcagaccctaaaacagttatattacttagatgttaaaattttctagtgggctgtgcaattgctgggttgtccccccaaacatattttaatatgttatttaaaatgattttacccaagcctaagtattaaagtatatgtgcaaaaacagttgtgagccattctattatgcttcagtatgtttttcttgtggcctaattacagaagaccaagctttagaaacttcttgtctaaatcatttcacatgcaagtcttatcctttctacaacactgataaacgtagagccttggcaaaaataaattttgtcattgtg

SEQ ID NO: 171096 - DNA, 4773 bp, Homo sapiens
  Payload ID: 13665
  Gene Symbol: PPP1R3E
  Gene Name: protein phosphatase 1, regulatory subunit 3E
  Uniprot ID: Q9H7J1
  ENST ID: ENST00000452015
  CDS Start-End: 273-1112
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagtatgtcataagatattcagaagtattgtgtgttttgggctaagggcagcaagagactcagaggcaagattccctccttgactcaatttcttggtcaccttgttttttgtgtgtgtgtgtccagaaaaatttaataagtttgcttaaattattataaagttgaaccactgaaatgttcactgaaacattttgacttgcattaatgctttacttccccacctacatttacattaaaaattcacacacaaatgaaaattgaaaactgacaacacctg

SEQ ID NO: 171097 - DNA, 3222 bp, Homo sapiens
  Payload ID: 13665
  Gene Symbol: PPP1R3E
  Gene Name: protein phosphatase 1, regulatory subunit 3E
  ENST ID: ENST00000558058
  CDS Start-End: 1-148
gggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccct

SEQ ID NO: 171098 - DNA, 1187 bp, Homo sapiens
  Payload ID: 13665
  Gene Symbol: PPP1R3E
  Gene Name: protein phosphatase 1, regulatory subunit 3E
  ENST ID: ENST00000559942
  CDS Start-End: 1-57
gagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgtcctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataa

SEQ ID NO: 171099 - DNA, 932 bp, Homo sapiens
  Payload ID: 13665
  Gene Symbol: PPP1R3E
  Gene Name: protein phosphatase 1, regulatory subunit 3E
  ENST ID: ENST00000560913
  CDS Start-End: 1-90
aacggcggccgtgactatgctctacgtgggcccgagcacccgggcagtggcggagctccggagccgcagggctggatccactttatctgagacgaggcgcctgcggccgacggcggaaaacaccaaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctg

SEQ ID NO: 171100 - DNA, 690 bp, Homo sapiens
  Payload ID: 13665
  Gene Symbol: PPP1R3E
  Gene Name: protein phosphatase 1, regulatory subunit 3E
  ENST ID: ENST00000561437
  CDS Start-End: 1-40
cggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaa

SEQ ID NO: 171101 - DNA, 2351 bp, Homo sapiens
  Payload ID: 13665
  Gene Symbol: PPP1R3E
  Gene Name: protein phosphatase 1, regulatory subunit 3E
  ENST ID: ENST00000559314
  CDS Start-End: 1-104
agttctgggacaacaacggcggccgtgactatgctctacgtgggcccgagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagaactatgactcgatcataaaatctgttttgtttgcatgcatgcccaaaacaaccctgaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctc

SEQ ID NO: 171102 - DNA, 3421 bp, Homo sapiens
  Payload ID: 13666
  Gene Symbol: PPP1R3F
  Gene Name: protein phosphatase 1, regulatory subunit 3F
  Uniprot ID: Q6ZSY5
  ENST ID: ENST00000055335
  CDS Start-End: 17-2416
cgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaacaaaataaaa

SEQ ID NO: 171103 - DNA, 2443 bp, Homo sapiens
  Payload ID: 13666
  Gene Symbol: PPP1R3F
  Gene Name: protein phosphatase 1, regulatory subunit 3F
  Uniprot ID: Q6ZSY5
  ENST ID: ENST00000376188
  CDS Start-End: 662-2023
acctcaagtggtctccctgcctcggcctcccaaagtgctggaattacaggtgtaagccaccacgcccagccgaaaagatgggttcttctatcttttctctttccatagccaggaatgtatcctaaagaaatgatacaagtgtcgataaaactatgcccaatgctgtttgctggtttgctttgcaacctctaaatgaaagaacttagctgctcagtaggaagggaatggtatgatatgagtattaagcagccatttgaaatgtttgcaaaagtgtataatgatgtttcttactgttaaatggacaaagctagctgtgaaattatgtctgtagaatctaaatgatttcgtagaatatctggaaggaaattttccagaatggtaacagtagttgtctctggctgatgtgtgattgtttttcttgcttctttagactttcctgtattttgcgaattttctataatgaggctgtaggacttttaggatgaggggataaacaaaggcagcagaagagaaaacagcagctgtcaggtgaaggtgggctagcacagaggctcagaaggtgccagtgggtggcagaagtgacctctcagggtattattagatccatgtactctctcctctgccctgcaggcctgccgaggaggaactgaagacgaagaacatggatgataacacctttgccatggagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgag

SEQ ID NO: 171104 - DNA, 1537 bp, Homo sapiens
  Payload ID: 13666
  Gene Symbol: PPP1R3F
  Gene Name: protein phosphatase 1, regulatory subunit 3F
  Uniprot ID: Q6ZSY5
  ENST ID: ENST00000495799
  CDS Start-End: 96-1457
atggcgcgtacggcccctgtggagcccccgctgcggcattccgcgcccccctcgccggccgcgggcctgccgaggaggaactgaagacgaagaacatggatgataacacctttgccatggagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctg

SEQ ID NO: 171105 - DNA, 503 bp, Homo sapiens
  Payload ID: 13666
  Gene Symbol: PPP1R3F
  Gene Name: protein phosphatase 1, regulatory subunit 3F
  ENST ID: ENST00000471261
  CDS Start-End: 1-485
agggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccagatgacacttcaggtgaaaagcaatcacggagttaaaagaagacaagctgaaatgatgcaggctgctcctatgttggaaatttgttcattaaaattctcccaataaagctttacagccttctgc

SEQ ID NO: 171106 - DNA, 1885 bp, Homo sapiens
  Payload ID: 13666
  Gene Symbol: PPP1R3F
  Gene Name: protein phosphatase 1, regulatory subunit 3F
  Uniprot ID: Q6ZSY5
  ENST ID: ENST00000466508
  CDS Start-End: 389-1750
gccgtcggtgccgccgccgccgccgatatggcgcgtacggcccctgtggagcccccgctgcggcattccgcgcccccctcgccggccgcggctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggagcatcctgatgtccaggagtcagtgggtccactggtagcccccacccctctccgtccatggccccagatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacaca

SEQ ID NO: 171107 - DNA, 4907 bp, Homo sapiens
  Payload ID: 13667
  Gene Symbol: PPP1R3G
  Gene Name: protein phosphatase 1, regulatory subunit 3G
  Uniprot ID: B7ZBB8
  ENST ID: ENST00000405617
  CDS Start-End: 906-1982
ggcctccggccgctctcggctgcgggccatggccgctccccggcgcgtccccacacggtccccgccccagtctggccgcagcccaccccgcgccgccactgggcagatgggggcggcggctcctgcctcccggctttcggaagagcagagcggagcgcgcctgaccgagtcaggcttccgagtgggattggaacccggggcgccctgaagtttggggaaagcaggagcagaagggaagggatgcgctccccgctctccggcggcgcggaatgggcctccttccagcctctgcgtaggcaagatttccccagttgcgcgctgcaccggggactccccagcccgtgaggcagccaagaggagagcgctcagtgaccctctgggggcagagccgtcaggccaagttcatgggcaggaagactttgtgcacgtgggggtctctgaaggttgagcgcgagctctgcacccccacttcgaggcactcaagaagcggaacagacgcgagccccgccgggggtgcgggtgagggctgcagggagcccgcgaacgacagaaagtcgccccccgcattccaccggagcactcgggaacacggcttccaggtgtcccagcggccgcgcctccccgcccccggccctcccccgtcgcgggcaggttcaaccgggaggcggcgtggccccggagccggccccaggcccgcatcctcctcccacttcgccctgggcagccgcagctaaaagccggaggctccaaagtggaactacgttgtcttgtcgagcctggggcgactcgcctcggggagggcgagcctgaactgcagccctgcgctccttccacggcccgaggagttagttaagtctccagaggggcccggttcggcccgagcaagtccaggggcgaacggcgtcatggagcccataggggcgcggctaagtttggaggcgccgggaccagcgcccttccgagaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctccgaagcttccctatgcgtgccgaggacctggagcagctcggggggctgctggccgcggcggcagtggccgcgcccctttcagcgccgccttcccggctccggccgctcttccagctcccggggccgagcgccgcggccgagcgtctgcagcggcagcgcgtgtgcctggagcgcgtgcagtgctcgacggcctcgggcgctgaggtgaagggctccggccgggtgctcagctgccctgggcccagggccgtgaccgtgcgctacacctttaccgagtggcgctccttcctggacgtgccggctgagctgcagcccgagccgctggagccacagcagccagaggcaccgtctggggcctccgagccagggtccggggatgccaagaaagagccaggcgccgagtgcttccacttctcgctgtgcctgcccccgggcctgcagcctgaggacgaagaggacgccgacgagcgcggcgtcgcggtccacttcgctgtctgctaccgctgcgcgcagggcgagtactgggacaacaacgcgggcgccaactacacgctgcgctacgcgcgccctgcggacgcgctctgagcctggagagtttcgaagagccgtggggcggggttgattagcacgtggagctcgggctgccgcctcaaggaacttgctgggacgctttgctgagcgtggcgagtctggcgtgaggggcgcgtggagggaaaggagggagactttgaaccgtcgactcgcacccccgcagacaagtgagcgagcttagagagcccgggcaatgctccgaaagcctctgacctcagtcttctcgtccgtttgaccttcctacaaggcctctagaattcccagcctgcgtcagaataggaagaaacttccaaggcccggagcagctgcctccaagaaaaaggctcccaactcccgggcatggttctaaggccttgggattggtttttaactctaaatatcatattgtagcccttgcagtttgctggagacccctagggaaagaacaaagcgtcctgccacggtgcaccagaggaaggtgccacggactgtgggtgcacgcgtgggacctttacaccccaacctatttctcagagaaaacccttcggggctgggccaggccacccttttcttttgactgagatgtgggtaatgtgtgcccagacttgacgttgtttattgtgcgacattgtgtacaaatgtcctttataaaagtaaaggccactcgcacccccttttacgctgtactctgaattttggctttcgtgagtttggggaggcattggcagtcggccgatctttgtcagctgatgatgtgcgcactttaacaatccttaaacaacagcctacaaattcctccccttcgttccttcctctctactgcgaaagggcccaaacttcccatgtgctttaaaatgttctgtagaaagtgttccgtccccctccgaattaagacgtttggtgaattgaaatgccagtcctcgggcaggccctggctgtgatctgcgagagccgggcacgcacgccccggcgccctttgtgtaggcagagcacactgttaggagacttgccgggccattagcagtcagagaagctgggcccttttagtcgctggactgccagcgcaggggatgggggatgggaaagtggctttctgttcctctcagagccacagtggggagtggtgacttgatggaagaggaggcatgcccagcgagtcagtgctgcgcagacgcagatggccacctctgcaggcccgttgggtggggtatggacggccttggtcgctgtgctggctgtggatgccaggatgatgtggccctctgtgcatgggtgggcaggagggcatcccgagtaaggtctgtcgccccttgactctgcctcagtgatttccctttttttaagtcttcccattttccagcacatggcgagtacagtcagtcgttttagggatggtagtctctaaggagggacagtttcactgttgcttgatagaacagggctgggcatacgtacatttggcccatgggccaaatttggcacacagcttattcttgtagggcctgtgacctaagaatagtttttacatttttatttttaatttaattttcttattattatttttcgagacggagtttcactcttgtcgcccaggctggagtgcaatgtgcgatcttggctcattgcaacctccgcctcccaggttcaagcgattctcctgcctcagcctccagagtagttgggagtacaggcatctgccaccacacctggctaatttttgtatttttggtagagacagggtttcaccatgttggccaggctagtcttgaactcctgacctcaggtgatccacccgccttggcctcccaaagtgctaggattataggcgtgagccacctcacctggccttacatttttaaattgttgaaaaaaattcaaaagaaagtactatttggtggcacgtgagaattatataaaatatatatttcagtgttcacaaatcaggttttactggaacacagccgtgcacactcatttctgtcttctctgtgctgcttccatgctaccgcagcagagtggagtagacacagcagagaccagatggcaaagtgtaaaatatttactatctggcccttttacaaaaggctggccaacccctgctctagggaagtagtgttttttaaacacaatatgctgacaattatagttaataaagcatttagactttagtgagcttttgccacttgaaataaaccccctttgggtaaaggtaaagctttatatgactctcagtaatcttgtttagaataaacacgaaaatgtgaaaagtgcggttatcattgtgtcaggcaggggaatctacctgttgccttctttcacctaaaaaaatagtaacacatcagtgcaactgaaacatagcacccgtttgaattggcttcaaactacaaagctgccagatatttctctgtgcttcaaaatgtggcatcttacacaatggaagtatttagtttgaactttgggttggagatatccctttgactatggcagtgtttcccaaagtaaactgatcataggaaaaaaataatttattgacagcaagccatcaggagttaacatattacaatttagacttttaaaaatggtcaatggtcatatcaatgaactaatgaatacttaattcatatatgcttataaaaactttgacgaaaaataaatgataaaatgaaacaatttttctgttactaaatataaaagctatgaagccttctgatgcatcatcaggtaatcttggtctgatataccatttcttaaaagtacattattgcataaccatatttttccgatatatttataaatacattaatttttaagatattgacagtatacatatgctataacattgtttgaaaatgcttgtttgtggggcaataaagcaacattttgaattgttttgaattacttaaaattaaatgaggagcccaatataatgattcaaacaga

SEQ ID NO: 171108 - DNA, 1084 bp, Homo sapiens
  Payload ID: 13668
  Gene Symbol: PPP1R42
  Gene Name: protein phosphatase 1, regulatory subunit 42
  Uniprot ID: Q7Z4L9
  ENST ID: ENST00000324682
  CDS Start-End: 146-832
gggacccggcgccgatgaaaccgaccaaactggagttagctaccggactgtcccgcgagcgaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactgggtacatatttatattaatataatttttaagagaatgacacctagttaactttttggttattttaccagcaagctttcagaaatataaatctgacatctggatctgtgaaaattgtcaactttaaattcaatattttgaataagagcaaaagttaaaattgacaaataaagcatgaaaaacatctgctgttcagaagtaattaaagcacctgatacttattccttaaggaggatattttgctattaccaataaaaatggttagtcataaa

SEQ ID NO: 171109 - DNA, 1282 bp, Homo sapiens
  Payload ID: 13668
  Gene Symbol: PPP1R42
  Gene Name: protein phosphatase 1, regulatory subunit 42
  ENST ID: ENST00000522909
  CDS Start-End: 186-1115
ggctgtactttgcattttgaagagtctaagaatacattccatatcttcaaatattttattgtgggcaatttataataacatagcctgggtaatgccaatgtaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactggaatttcttgatggaaaagaaattaaaaatatagaaagacaattcctaatgaattggaaagcatccaaagatgccaagaaaatcagcaaaaaaaggagcagtaaaaatgaggatgcaagcaattcactcataagtaacttcaaaacaatgcatcatatagttcctgtttattacccacaggtgggtaagccaaaattagcctttttctctgaaatacagagataccctgtaaatgcaaatgcatctccagaaagttcctgagaagattacactaaaattatttaagagatggggaatctctctttgaagcaatctgaaagcttgctgacaaaaaatgatgtgcatgaacctcacctcttccataacccagaagaaaaagaaaatttgtttgtggaaaatgagtaaattcagcctcaagtgacaggaaa

SEQ ID NO: 171110 - DNA, 2386 bp, Homo sapiens
  Payload ID: 13669
  Gene Symbol: PPP1R7
  Gene Name: protein phosphatase 1, regulatory subunit 7
  Uniprot ID: Q15435
  ENST ID: ENST00000234038
  CDS Start-End: 475-1557
agacgcagccagcgaggctcgcagaggtcagggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgtcacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagaca

SEQ ID NO: 171111 - DNA, 1954 bp, Homo sapiens
  Payload ID: 13669
  Gene Symbol: PPP1R7
  Gene Name: protein phosphatase 1, regulatory subunit 7
  Uniprot ID: Q15435
  ENST ID: ENST00000272983
  CDS Start-End: 839-1792
cgcccccgggccgggcagatgcggtttcctcccgactcgcgatcaaaatgggtgagtagcgcagagctcgcctcttggaggcctctttctgaaggcggaggacgcggggcggctcgttcatgggccgggtggctccgcagggtagacgaaggctgcagcgtccgcactgggctgggaacgacttgcaaggggagcccagctggcgccccggagccagccagctggctagcggccccaccagcgcaagtgccccgcacctgcccgcctgctccgagcgtcaagagaaggcggcatttcgcatgggtaaaatccgcgcggggacgccgggagaatgttgttgctcttgccgttcggcccattgtacagacgcagccagcgaggctcgcagaggtcagggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgtcacacacca

SEQ ID NO: 171112 - DNA, 883 bp, Homo sapiens
  Payload ID: 13669
  Gene Symbol: PPP1R7
  Gene Name: protein phosphatase 1, regulatory subunit 7
  Uniprot ID: Q15435
  ENST ID: ENST00000402734
  CDS Start-End: 114-779
gttgctagggacgcaccaaacacccctacggcgcttcggaggagccaaaggaataatgggcgcctccgcccccgggccgggcagatgcggtttcctcccgactcgcgatcaaaatggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattc

SEQ ID NO: 171113 - DNA, 965 bp, Homo sapiens
  Payload ID: 13669
  Gene Symbol: PPP1R7
  Gene Name: protein phosphatase 1, regulatory subunit 7
  Uniprot ID: Q15435
  ENST ID: ENST00000406106
  CDS Start-End: 17-859
gggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 171114 - DNA, 820 bp, Homo sapiens
  Payload ID: 13669
  Gene Symbol: PPP1R7
  Gene Name: protein phosphatase 1, regulatory subunit 7
  Uniprot ID: Q15435
  ENST ID: ENST00000401987
  CDS Start-End: 1-714
atggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 171115 - DNA, 1009 bp, Homo sapiens
  Payload ID: 13669
  Gene Symbol: PPP1R7
  Gene Name: protein phosphatase 1, regulatory subunit 7
  ENST ID: ENST00000404405
  CDS Start-End: 79-903
ggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 171116 - DNA, 1592 bp, Homo sapiens
  Payload ID: 13669
  Gene Symbol: PPP1R7
  Gene Name: protein phosphatase 1, regulatory subunit 7
  Uniprot ID: Q15435
  ENST ID: ENST00000407025
  CDS Start-End: 309-1391
aaaggaataatgggcgcctccgcccccgggccgggcagatgcggtttcctcccgactcgcgatcaaaatggcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgtcacacaccattttcagatgccgttgcaattaaatcttgccacactgtc

SEQ ID NO: 171117 - DNA, 1030 bp, Homo sapiens
  Payload ID: 13669
  Gene Symbol: PPP1R7
  Gene Name: protein phosphatase 1, regulatory subunit 7
  ENST ID: ENST00000450367
  CDS Start-End: 1-1007
ggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtgg

SEQ ID NO: 171118 - DNA, 976 bp, Homo sapiens
  Payload ID: 13669
  Gene Symbol: PPP1R7
  Gene Name: protein phosphatase 1, regulatory subunit 7
  ENST ID: ENST00000438799
  CDS Start-End: 130-976
gaagcccgcgctaagggttgctagggacgcaccaaacacccctacggcgcttcggaggagccaaaggaataatgggcgcctccgcccccgggccgggcagatgcggtttcctcccgactcgcgatcaaaatggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgc

SEQ ID NO: 171119 - DNA, 421 bp, Homo sapiens
  Payload ID: 13669
  Gene Symbol: PPP1R7
  Gene Name: protein phosphatase 1, regulatory subunit 7
  ENST ID: ENST00000427172
  CDS Start-End: 1-421
ctcgaaggcaacgaggttggggatagggtgagggaaaagagcaagaatcactcaagacggagaaaactgctgtcaaaagttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccaga

SEQ ID NO: 171120 - DNA, 583 bp, Homo sapiens
  Payload ID: 13669
  Gene Symbol: PPP1R7
  Gene Name: protein phosphatase 1, regulatory subunit 7
  ENST ID: ENST00000439916
  CDS Start-End: 30-583
agattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagagatttctgctttgtttcaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaat

SEQ ID NO: 171121 - DNA, 959 bp, Homo sapiens
  Payload ID: 13669
  Gene Symbol: PPP1R7
  Gene Name: protein phosphatase 1, regulatory subunit 7
  ENST ID: ENST00000423280
  CDS Start-End: 93-959
acccctacggcgcttcggaggagccaaaggaataatgggcgcctccgcccccgggccgggcagatgcggtttcctcccgactcgcgatcaaaatggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccc

SEQ ID NO: 171122 - DNA, 514 bp, Homo sapiens
  Payload ID: 13669
  Gene Symbol: PPP1R7
  Gene Name: protein phosphatase 1, regulatory subunit 7
  ENST ID: ENST00000415769
  CDS Start-End: 1-325
ggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagaca

SEQ ID NO: 171123 - DNA, 2414 bp, Homo sapiens
  Payload ID: 13670
  Gene Symbol: PPP1R8
  Gene Name: protein phosphatase 1, regulatory subunit 8
  Uniprot ID: Q12972
  ENST ID: ENST00000236412
  CDS Start-End: 949-1332
aaatgggagggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctgtacgtcccgagcgcgctcgagccagccccggccccaaccctacctccaagccccgcatccctctgtggttgctgcatccctcgtgcggcacttgtctgtctgccacagagaatacgaggggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtaaacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 171124 - DNA, 2344 bp, Homo sapiens
  Payload ID: 13670
  Gene Symbol: PPP1R8
  Gene Name: protein phosphatase 1, regulatory subunit 8
  Uniprot ID: Q12972
  ENST ID: ENST00000311772
  CDS Start-End: 59-1114
cggtcttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtggaaa

SEQ ID NO: 171125 - DNA, 2651 bp, Homo sapiens
  Payload ID: 13670
  Gene Symbol: PPP1R8
  Gene Name: protein phosphatase 1, regulatory subunit 8
  Uniprot ID: Q12972
  ENST ID: ENST00000373931
  CDS Start-End: 796-1425
gggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtg

SEQ ID NO: 171126 - DNA, 1029 bp, Homo sapiens
  Payload ID: 13670
  Gene Symbol: PPP1R8
  Gene Name: protein phosphatase 1, regulatory subunit 8
  ENST ID: ENST00000431586
  CDS Start-End: 414-1029
tccctcgtgcggcacttgtctgtctgccacagagaatacgaggggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacacctt
